US010160976B2

(12) United States Patent
Cordova-Kreylos et al.

(10) Patent No.: US 10,160,976 B2
(45) Date of Patent: Dec. 25, 2018

(54) CHROMOBACTERIUM SUBTSUGAE GENOME

(71) Applicant: Marrone Bio Innovations, Inc., Davis, CA (US)

(72) Inventors: Ana Lucia Cordova-Kreylos, Davis, CA (US); Debora Wilk, Davis, CA (US); Pamela Marrone, Davis, CA (US)

(73) Assignee: Marrone Bio Innovations, Inc., Davis, CA (US)

(*) Notice: Subject to any disclaimer, the term of this patent is extended or adjusted under 35 U.S.C. 154(b) by 0 days.

(21) Appl. No.: 15/510,369

(22) PCT Filed: Aug. 20, 2015

(86) PCT No.: PCT/US2015/046045
§ 371 (c)(1),
(2) Date: Mar. 10, 2017

(87) PCT Pub. No.: WO2016/039961
PCT Pub. Date: Mar. 17, 2016

(65) Prior Publication Data

US 2017/0290341 A1 Oct. 12, 2017

Related U.S. Application Data

(60) Provisional application No. 62/049,016, filed on Sep. 11, 2014.

(51) Int. Cl.

| | |
|---|---|
| ***C12N 15/82*** | (2006.01) |
| ***C12N 9/24*** | (2006.01) |
| ***C12N 9/42*** | (2006.01) |
| ***A01N 37/46*** | (2006.01) |
| ***A01N 63/02*** | (2006.01) |
| ***C12N 9/52*** | (2006.01) |
| ***C07K 14/42*** | (2006.01) |

(52) U.S. Cl.
CPC ......... *C12N 15/8286* (2013.01); *A01N 37/46* (2013.01); *A01N 63/02* (2013.01); *C07K 14/42* (2013.01); *C12N 9/2442* (2013.01); *C12N 9/52* (2013.01); *Y02A 40/162* (2018.01)

(58) Field of Classification Search
None
See application file for complete search history.

(56) References Cited

U.S. PATENT DOCUMENTS

| | | | | |
|---|---|---|---|---|
| 5,993,808 A * | 11/1999 | Melchers | ............... | A01N 65/00 424/94.61 |
| 8,808,719 B1 | 8/2014 | Flor-Weiler et al. | | |
| 2012/0100236 A1 | 4/2012 | Asolkar et al. | | |

FOREIGN PATENT DOCUMENTS

| | | | |
|---|---|---|---|
| WO | 2004/056960 A2 | | 7/2004 |
| WO | WO 2004/056960 | * | 7/2004 |
| WO | 2005/032250 A2 | | 4/2005 |

OTHER PUBLICATIONS

Guo et al, 2004, Proc. Natl. Acad. Sci. USA 101: 9205-9210.*
Brazilian National Genome Project Consortium, "The complete genome sequence of Chromobacterium violaceum reveals remarkable and exploitable bacterial adaptability." PNAS, Sep. 18, 2003, vol. 100, No. 20, pp. 11660-11665.
International Search Report and Written Opinion PCT/US2015/046045 dated Oct. 28, 2015, 13 pp.
Martin, Phyllis A. W. et al., "*Chromobacterium subtsugae* sp. nov., a betaproteobacterium toxic to Colorado potato beetle and other insect pests." Int. J. Syst. Eval. Microbial., May 2007, vol. 57, pp. 993-999.
NCBI Reference Sequence: WP_011135547.1, May 24, 2013, 2 pp.
NCBI Reference Sequence: WP_021478876.1, Sep. 22, 2013, 2 pp.
EBI Reference Sequence: XP-002777362; "Chromobacterium violaceum ATCC 12472 probable chitinase"; Jan. 1, 2006; 3 pages.
Supplemental Partial European Search Report and Provisional Opinion; dated Jan. 31, 2018; 13 pages.

* cited by examiner

*Primary Examiner* — Anne Kubelik
(74) *Attorney, Agent, or Firm* — Chainey P. Singleton; Ying-Horng Liu

(57) ABSTRACT

Disclosed herein is the nucleotide sequence of the *Chromobacterium subtsugae* genome. Also provided are the nucleotide sequences of open reading frames in the *C. subtsugae* genome (i.e., *C. subtsugae* genes). In addition, the amino acid sequences of proteins encoded by the *C. subtsugae* genome are provided. Nucleic acids, vectors and polypeptides comprising the aforementioned sequences are also provided. Homologues, functional fragments and conservative variants of the aforementioned sequences are also provided. Compositions having pesticidal, bioremedial and plant growth-promoting activities comprising *C. subtsugae* genes and proteins, and methods for the use of these compositions, are also provided.

12 Claims, No Drawings

Specification includes a Sequence Listing.

CHROMOBACTERIUM SUBTSUGAE GENOME

CROSS-REFERENCE TO RELATED APPLICATIONS

This application is the National Stage of International Application No. PCT/US2015/046045, filed on Aug. 20, 2015 which claims the benefit under 35 U.S.C. § 119(e) of U.S. Provisional Application No. 62/049,016, filed Sep. 11, 2014. All of which are hereby incorporated by reference in their entirety.

REFERENCE TO A SEQUENCE LISTING

This instant application contains a Sequence Listing which has been submitted in ASCII format via EFS-Web. Said ASCII copy is named MBI-203-0006-US-PR1_ST25.txt and is 24,039,565 bytes in size.

TECHNICAL FIELD OF THE INVENTION

The present disclosure is in the field of biopesticides; in particular bacterial pesticides, their genes and their gene products.

BACKGROUND ART

*Chromobacterium subtsugae* In 2000, a purple-pigmented *bacterium* (PRAA4-1) was isolated from forest soil in Maryland (Martin et al., 2004). In initial screens, this *bacterium* was found to be toxic to Colorado potato beetle and other insect pests (Martin et al., 2007a). Additional work with the isolate revealed activity gainst mites, grubs, diverse beetle species, aphids and plant parasitic nematodes, among other plant pests (Martin et al., 2007b, US Patent Application Publication No. 2012/0100236 A1).

Proteases and Insect Control Proteases have the ability to target and destroy essential proteins and tissues of insects. Plants have naturally evolved to express proteases to protect against insects. Insect predators also produce protease in their venom, which contributes to mortality. Proteases have been identified as important insecticidal agents for control of insects in agriculture.

Proteases with insecticidal activity fall into three general categories: cysteine proteases, metalloproteases and serine proteases. Proteases of these classes target the midgut, cuticle and hemocoel. The peritrophic matrix of the midgut is an ideal target for insect control because it lines and protects the midgut epithelium from food particles, digestive enzymes and pathogens; in addition to acting as a biochemical barrier (Hegedus at al., 2009). Enhancins are zinc metalloproteases expressed by baculoviruses that facilitate nucleopolyhedrovirus infections in lepidopterans (Lepore et al., 1996). These proteases promote the infection of lepidopteran larvae by digesting the invertebrate intestinal mucin protein of the peritrophic matrix, which in turn promotes infection of the midgut epithelium (Wang and Granados, 1997). Homologs of enhancin genes found in baculovirus have been identified in the genomes of *Yersinia pestis, Bacillus anthracis, Bacillus thuringiensis* and *Bacillus cereus* (Galloway et al., 2005; Hajaij-Ellouze et al., 2006).

Plant cysteine proteases also demonstrate activity against lepidopteran larvae. Cysteine proteases in the latex of the papaya and wild fig trees are essential in the defense against various lepidopteran larvae. Toxicity to the larvae was lost when the latex was washed or when the leaves were treated with a cysteine protease-inhibitor, indicating that the defense may be due to the high concentration of cysteine proteases in the latex (Konno et al., 2004).

Proteases that target the cuticle are also important in insect control. The cuticle covers the entire outside of the insect as well as some invaginations of internal structures. The cuticle is composed of a waxy epicuticle, an exocuticle and an endocuticle that consist of protein, lipid and chitin (Harrison and Bonning 2010). Fungal infection of insects by *Metarhizium anisopliae* and *Beauveria bassiana* occurs when the fungal spores germinate on the cuticle, forming structures for penetration of the cuticle by a variety of enzymes, including proteases (Freimoser at al., 2003; Cho et al., 2006). One notable serine protease produced by *M. anisopliae,* PR1A, digests the cuticle and plays an essential role in penetration (St. Leger et al. 1987). A clone of *M. anisopliae* was engineered to contain additional copies of the pr1a gene and showed 25% more kill of tobacco hornworm than the wild-type (St Leger et al., 1996). *B. basianna* was also engineered to express the *M. anisopliae* PR1A protease and demonstrated increased toxicity of larvae of the Masson's pine caterpillar, *Dendrolimus punctatus,* and the wax moth, *Galleria mellonella* (Lu et al., 2008).

The basement membrane of insects consists of proteins that surround the tissue and contribute to a variety of functions from structural support to barriers for viruses. Three potential basement membrane-degrading proteins were evaluated using *Autographa californica* multiple nucleopolyhedrovirus (AcMNPV). This baculovirus was engineered to express two vertebrate metalloproteases, rat stromelysin and human geatinase A, as well as the fruit fly cathepsin L, ScathL. The ScathL protease demonstrated the best baculovirus activity. The median survival time of infected tobacco budworm larvae was reduced by 50% when compared to wild-type infected larvae (Harrison and Bonning, 2001). This data supports the idea that proteases expressed in viruses have the ability to access the basement membrane of insects, which generally functions as a barrier to viruses. A previous report identified two basement membrane proteins of imaginal discs of fruit fly larvae that are susceptible to hydrolysis by cathepsin L (Homma and Natori, 1996). Purified ScathL protease was also toxic to a variety of insect pests when it was injected into the hemocoel. The purified protease demonstrated similar melanization, mortality and hemolymph protease activity in lepidopteran larvae as was seen ScathL expressed baculovirus infections (Li et al., 2008). Basement membrane damage is cause by purified ScathL protease both in vivo and in vitro (Tang et al., 2007; Philip et al. 2007).

Arthropod predators have also been shown to contain basement membrane cleaving proteases in their venom. One example is the parasitic wasp, *Eulophus pennicornis,* in which 3 metalloproteinases (EpMP1-3) were identified in the venom glands. Recombinant EpMP3 was injected into the hemocoel of *Lacanobia oleracea* larvae and resulted in significant mortality, or impaired development and growth in surviving larvae (Price et al., 2009). Social aphid soldier nymphs produce a toxic cathepsin B protease (cysteine protease) in their intestines. The protease is orally excreted into enemies and demonstrates insecticidal activity (Kutsukake et al., 2008).

A protease isolated from the *bacterium, Xenorhabdus nematophilia,* has been shown to suppress antibacterial peptides involved in insect immune response, making the insect susceptible to the pathogenetic process (Caldas et al., 2002). The enterobacterium, *Photorhabdus luminscense,* has been shown to be pathogenic to a broad spectrum of insects. The genome sequence of this *bacterium* identified genes related to toxicity, including proteases (Duchaud et al., 2003).

The use of proteases as insecticides has been of interest to plant modifications as well. Basement-membrane degrading proteases have been characterized and engineered for transgenic insecticidal protocols, with the goal of developing transgenic plants that are resistant to insect pests (U.S. Pat. No. 6,673,340, Harrison and Bonning, 2004). Proteases in the gut of insects have been shown to affect the impact of *Bacillus thuringiensis* Cry insecticidal proteins. Some proteases activate Cry proteins by processing them from a protoxin to a toxic form. Insect toxins have been modified to comprise proteolytic activation sites with the goal of incorporating this modification into transformed plants, plant cells and seeds. Cleavage of these sites by the insect gut protease results in an active insect toxin within the gut of the pest (U.S. Pat. No. 7,473,821, Abad et al., 2009).

Insecticidal Activity of Chitinases Chitinases expedite insecticidal activity by puncturing the insect midgut lining and degrading the insect cuticle. Degradation of these membranes exposes the insects to pathogens, to other insecticidal compounds, and/or to plant defenses.

Chitinases hydrolyze the structural polysaccharide chitin, a linear homopolymer of 2-acetamido-2-deoxy-D-glucopyranoside, linked by β-1→4-linkages, which is a component of the exoskeleton and gut lining of insects. Chitinases are classified as either family 18 or family 19 glycosyl hydrolases. Family 18 chitinases are widespread, found in bacteria, plants, and animals; while family 19 chitinases are mainly found in plants (Henrissat and Bairoch, 1993). In insects, Chitinases play a role in molting (Samuels and Reynolds, 1993, Merzendorfer and Zimoch, 2003).

Chitinases alone show some insecticidal activity. Chitinase from *Serretia marcenscens* was found to be toxic to seventh instar *Galleria mellonella* larvae (Lysenk, 1976). Transgenic plants which express insect chitinases have been shown to have increased resistance to insect pests. Tobacco plants were transformed with cDNA encoding a *Manduca sexta* chitinase. Leaves from these transgenic plants were infested with *Heliothis virescens* larvae. After 3 weeks it was found that chitinase positive leaves had less larval biomass and feeding damage than chitinase negative leaves. It is possible that the activity of the chitinases render insects more susceptible to plant defenses (Ding, et al., 1997).

Insect cuticles provide a physical barrier to protect the insect form pathogens or other environmental hazards, and are composed primarily of chitin (Kramer, et al., 1995). Entomopathogenic fungi *Metarhizium anisopliae, Beauvaria bassiana, Beauvaria amorpha, Verticillium lecanii,* and *Aspergillus flavus* all secrete chitinases to break down the cuticle and enter the insect host (St Leger, et al., 1986, 1992, Campos, et al. 2005). According to Kim, et al., chitinase-containing supernatants of *Beauveria bassina* were toxic to *Aphis gossypii* adults. However, when these supernatants were treated with an excess of chitin to inhibit the activity of the fungal chitinases, this mortality was significantly reduced, suggesting that chitinase plays an integral role in breaking down the cuticle and facilitating infection (Kim, et al. 2010). Chitinases have also been isolated from the venom of the endoparasitic wasp *Chelonus* sp., where they possibly help the venom penetrate the defenses of chitin protected prey (Krishnan, et al., 1994).

The peritrophic membrane, which lines the insect midgut, is another primarily-chitin-composed barrier that protects insects from pathogens. Any enzyme that can puncture this membrane has potential as a bioinsecticide (Wang and Granados, 2001). Hubner, et al. demonstrated that malarial parasites excrete chitinases to penetrate the peritrophic membrane in mosquitoes (Hubner, et al., 1991), and Shahabuddin, et al. confirmed that inhibition of chitinase with allosamidin is sufficient to prevent the malarial parasite *Plasmodium gallinaceum* from crossing the peritrophic membrane of *Anopheles freeborni.* Also, the addition of exogenous chitinase from *Streptomyces griseus* during the development of the *Anopheles freeborni* midgut prevented the formation of the peritrophic membrane (Shahabuddin, et al., 1993). This demonstrates that chitinases can break down the peritrophic membrane. Regev, et al. used *E. coli* to express *Serratia marcescens* endochitinase ChiA and confirmed with electron microscopy that *Spodoptera littoralis* larvae exposed to the endochitinase exhibited perforations in the peritrophic membrane (Regev, et al., 1996).

Because of the ability of chitinase to perforate the peritrophic membrane, endochitinases have also been shown to increase the insecticidal activity of *Bacillus thuringiensis* (Bt). *Choristoneura fumiferana* larvae reared on *Agies balsamea* treated with a mixture of a diluted commercial formulation of Bt and chitinase were killed more quickly than larvae reared on foliage treated with just Bt alone (Smirnoff, 1973). A mixture of a low concentration of Bt and *S. marcenscens* chitinase also resulted in higher mortality of *Spodoptera littoralis* larvae than Bt alone (Sheh et al., 1983). It is believed that this synergistic effect is due to puncturing of the peritrophic lining of the insect gut by the chitinase, facilitating the penetration of Bt spores into the insect. (Smirnoff, 1973).

Yen-Tc, an ABC type protein that is both necessary and sufficient for the entomopathogenicity of *Yersinia entomophaga* in the insect *Costelytra zealandica,* contains two family 18 chitinases, making it the first insecticidal toxin complex identified to incorporate chitinases. It is hypothesized that the chitinases are responsible for breaking down peritrophic membrane and exposing the midgut epithelial cells to the toxin. However, the chitinases may only be active in regions of the midgut with a relatively neutral pH (Busby, 2012).

Chitinases are also integral to the activity of some insect viruses. Hatwin, et al. created mutants of the *Autographa californica* nucleopolyhedrovirus (AcMNPV) that lacked the gene for chitinase. Usually, this virus causes liquefaction of the host larvae, facilitating the spread of the virus. This liquefaction did not occur when *Trichoplusia ni* larvae were infected with the chitinase negative virus. It was also confirmed that the AcMNPV chitinase is active under the alkaline conditions of the insect midgut (Hatwin, et al. 1997). A recombinant version of the same *Autographa californica* nucleopolyhedrovirus that expressed a *Haemaphysalis longicornis* chitinase was found to have bioarcaricidal activity against *Haemaphysalis longicornis* nymphs (Assegna, et al. 2006).

Rhs-like Genes Encode Insecticidal Toxins The rhs (rearrangement hotspot) gene family was first identified in *E. coli.* These genes confer chromosomal rearrangements by homologous exchange (Lin et al., 1984). They are 2 to 12 kb in size and exhibit a long core with a short tip. The core sequences are GC rich and highly conserved, but the tip sequences are GC-poor and highly variable. They encode proteins that have a large core domain and a short C-terminal tip domain. The protein core domain is hydrophilic and contains YD-repeats (Jackson et al., 2009). The Rhs proteins are capable of interacting with bacterial cell surfaces and binding to specific ligands (Wang et al., 1998). While the function of the Rhs proteins remains unknown (Hill et al., 1994), the structure is important because the YD repeats and highly conserved sequences resemble rhs and rhs-like genes encoding insecticidal toxins produced by bacteria.

*Photorhabdus luminescens* is a mutualistic symbiont of the nematodes from the Heterorhabditae family. The nematode infects the insect and injects the *bacterium* into the hemocoel of the insect. The *bacterium* then secretes toxins that kill the insect (Frost et al., 1997). Bowen et al. (1998), purified a high molecular weight protein associated with oral and injectable insecticidal toxicity that targets insects. In another study, Bowen et al. (1998) used high performance liquid chromatography to separate this protein into four toxin complexes (tc) termed, Tca, Tcb, Tcc, and Tcd encoded by the tc loci (Bowen et al., 1998). Waterfield et al. (2001) analyzed recombinant expression of the tc genes in *E. coli* to understand oral toxicity of Tc proteins. They found that without tccC-like homologs, they could not recover oral toxicity in *E. coli.* These authors concluded that TccC is involved in activation of toxin secretion. Furthermore, an amino acid sequence analysis revealed TccC and TccC-like proteins have a highly conserved core and highly variable extension. This structure bears resemblance to rhs-like elements (Waterfield N R, Bowen D J, Fetherston J D, Perry R D, and ffrench-Constant, R H, 2001). This similarity suggests that TccC-like and Rhs proteins share an ancient role in toxin mobility and activation for the Enterobacteriaceae family (ffrench-Constant, R et al, 2003).

Another microbe, *Serratia entomophila,* has insecticidal activity that targets New Zealand grass grub, *Costelytra zealandica,* and causes amber disease (Grimont et al., 1988). The virulence of *S. entomophila* is linked to a large plasmid called amber disease-associated plasmid (pADAP) (Glare et al., 1993). Hurst et al. analyzed the mutagenesis and the nucleotide sequence of pADAP to understand how it confers pathogenicity to grass grub. They found that pADAP encodes three genes responsible for the symptoms of amber disease, sepA, sepB, and sepC. All three genes are required for pathogenicity because a mutation in these genes abolishes amber disease. They illustrated that proteins encoded by the sep genes are similar to the proteins encoded by the insecticidal toxin complexes of *P. luminescens.* For example, the first 680 amino acids of SepC and TccC show a strong similarity. Furthermore, this region resembles the rhs elements of *E. coli.* The sepC gene is smaller than Rhs elements, but it encodes a hydrophilic protein core with nine Rhs peptide variants. Based on the similarity between the sep and tc genes, Hurst et al. concludes that these products are part of a new group of insecticidal toxins (Hurst et al., 2000).

Harada et al. discovered that, *Pantoea stewartii* ssp. DC283 is an aggressive pathogen that infects aphids (Harada et al., 1996). The aphid ingests the *bacterium* and DC283 is able to aggregate in the gut and cause death of the aphid. Stavrinides et al. performed a mutagenesis screen and discovered that the ucp1 (you cannot pass) locus is responsible for the virulence of DC283. Analysis of the ucp1 gene sequence revealed similarities to the Rhs protein family. ucp1 gene is smaller than the genes encoding RHS/YD proteins and does not have a ligand binding YD repeat, but it has conserved 5'-cores, non-homologous 3'ends, and it is a membrane bound protein. These structural similarities suggest enteric plant colonizers have the genetic ability to colonize insect hosts. Furthermore, the similarities between the ucp1 and rhs genes suggest that rhs-like genes have potential insecticidal activity (Stavrinides et al., 2010).

DISCLOSURE OF THE INVENTION

The present disclosure provides the nucleotide sequence of the genome of the *bacterium Chromobacterium subtsugae.* Isolation and partial characterization of this *bacterium* is described, for example, in U.S. Pat. No. 7,244,607. Also provided are the nucleotide sequences of open reading frames in *C. subtsugae;* i.e., *C. subtsugae* gene sequences. Additionally provided are amino acid sequences of polypeptides encoded by the *Chromobacterium subtsugae* genome.

The present disclosure also provides isolated nucleic acids (e.g., DNA, RNA, nucleic acid analogues) comprising *C. subtsugae* genomic sequences, gene sequences, fragments thereof, and or mutant variants. Also provided are nucleic acid vectors (e.g., plasmid vectors, viral vectors), including expression vectors, comprising nucleic acids having *C. subtsugae* genome sequences, gene sequences, regulatory sequences and/or fragments thereof. Exemplary bacterial vectors include, but are not limited to, *Agrobacterium tumefaciens, Rhizobium* sp. NGR234, *Sinorhizobium meliloti,* and *Mesorhizobium loti.*

Exemplary viral vectors include, but are not limited to, cauliflower mosaic virus (CaMV), pea early browning virus (PEBV), bean pod mottle virus (BPMV), cucumber mosaic virus (CMV), apple latent spherical virus (ALSV), tobacco mosaic virus (TMV), potato virus X, brome mosaic virus (BMV) and barley stripe mosaic virus (BSMV).

Cells transfected with the foregoing nucleic acids or vectors are also provided. Such cells can be plant cells, insect cells, mammalian cells, bacterial cells, or fungal cells (e.g., yeast). Plants comprising cells (plant or otherwise) that have been transfected with the foregoing nucleic acids or vectors, seeds from said plants, and the progeny of said plants are also provided. Transfected bacterial cells can include Agrobacteria (e.g., *Agrobacterium tumefaciens*), *Rhizobium, Sinorhizobium meliloti,* and *Mesorhizobium loti.* Insect vectors (e.g., *Homalodisca vitripennis,* the glassy-winged sharpshooter) comprising nucleic acid vectors which themselves comprise *C. subtsugae* sequences, are also provided.

In additional embodiments, polypeptides encoded by the *C. subtsugae* genome are provided. Functional fragments of *C. subtsugae* polypeptides, and conservatively substituted variants of *C. subtsugae* polypeptides, are also provided.

In further embodiments, plants comprising one or more isolated nucleic acids comprising *C. subtsugae* genomic sequences, gene sequences and/or fragments thereof are provided. These isolated nucleic acids can be present on the exterior of the plant or internally.

In additional embodiments, plants comprising one or more nucleic acid vectors, wherein said vector or vectors comprise *C. subtsugae* genome sequences, gene sequences and/or fragments thereof, are provided. Said vectors can be present on the exterior of the plant or internally.

In yet additional embodiments, plants comprising one or more *C. subtsugae* polypeptides are provided. Said *C. subtsugae* polypeptides can be present on the exterior of the plant or internally.

Also provided are plants comprising one or more functional fragments and/or one or more conservatively substituted variants of a *C. subtsugae* polypeptide or polypeptides. Said fragments and/or conservatively substituted variants can be present on the exterior of the plant or internally.

Progeny of the aforementioned plants are also provided. In addition, seeds from the aforementioned plants, and from their progeny, are provided.

Also disclosed herein are methods for controlling pests; e.g., methods for modulating pest infestation in a plant. Such pests can be, for example, insects, fungi, nematodes, mites, moths or aphids. The methods include application of a nucleic acid comprising a *C. subtsugae* genome sequence, gene sequence, or fragment thereof to a plant, either internally or externally. Additional methods include application of a *C. subtsugae* polypeptide, or fragment thereof, or conservatively substituted variant thereof, to a plant, either internally or externally.

Also provided are pesticidal (e.g., insecticidal) compositions comprising nucleic acids and/or polypeptides encoded by the *C. subtsugae* genome. Such compositions can optionally include other insecticides or pesticides, either naturally-occurring or man-made.

Also provided is a computer-readable medium comprising the sequence information of any of the nucleotide or amino acid sequences disclosed herein (i.e., any of SEQ ID NOs 1-8960) or any fragment thereof. Also provided are computerized systems and computer program products containing the nucleic acids and polypeptide sequences disclosed herein on a computer-readable medium, for use in, for example, sequence analysis and comparison.

Accordingly, disclosed herein, inter alia, are the following embodiments: (1) An isolated nucleic acid having the sequence of any one of SEQ ID NOs: 1-4533. Nucleic acids as disclosed herein can be DNA, RNA, or any nucleic acid analogue known in the art. (2) An isolated nucleic acid having 10 or more contiguous nucleotides of the sequence of SEQ ID NO: 1. Nucleic acids as disclosed herein can be DNA, RNA, or any nucleic acid analogue known in the art. (3) An isolated nucleic acid having 10 or more contiguous nucleotides of the sequence of any one of SEQ ID NOs: 2-4533. Nucleic acids as disclosed herein can be DNA, RNA, or any nucleic acid analogue known in the art. (4) An isolated nucleic acid comprising a *C. subtsugae* regulatory sequence. (5) The nucleic acid of embodiment 4, wherein the regulatory sequence is a promoter or an operator. (6) The nucleic acid of embodiment 4, wherein the regulatory sequence is a transcription terminator. (7) An isolated nucleic acid comprising a sequence that is complementary to the sequence of any of the nucleic acids of embodiments 1-6. (8) A nucleic acid vector comprising the isolated nucleic acid of any of embodiments 1-7. (9) The nucleic acid vector of embodiment 8, wherein the vector is an expression vector. (10) An isolated polypeptide having the sequence of any one of SEQ ID NOs: 4534-8960. (11) An isolated polypeptide having 10 or more contiguous amino acids of the sequence of any one of SEQ ID NOs: 4534-8960. (12) A functional fragment of the polypeptide of embodiment 10. (13) A conservatively substituted variant of the polypeptide of embodiment 10. (14) A polypeptide comprising an amino acid sequence having at least 75% homology to the sequences of any of embodiments 10-13. (15) An isolated nucleic acid encoding a polypeptide according to any of embodiments 10-14. (16) An isolated nucleic acid comprising a sequence that is complementary to the sequence of the nucleic acid of embodiment 15. (17) An isolated nucleic acid comprising a sequence having at least 75% homology to the sequences of any of embodiments 1-7, 15 or 16, or to either of the vectors of embodiments 8 or 9. (18) A cell comprising the isolated nucleic acid of any of embodiments 1-7, 15 or 16, or with the nucleic acid vector of either of embodiments 8 or 9. Such cells can be, e.g., plant cells, insect cells, bacterial cells (e.g., *Agrobacterium*) or fungal cells (e.g., yeast). (19) A plant comprising one or more cells according to embodiment 18. (20) The plant of embodiment 19 wherein the cell is a plant cell. (21) The plant of embodiment 20 wherein the cell is of the same species as the plant. (22) The progeny of the plant of any of embodiments 19-21. (23) A seed from the plant of any of embodiments 19-22. (24) A plant comprising one or more nucleic acids according to any of embodiments 1-7 or 15-17, or one or more of the nucleic acid vectors of embodiments 8 or 9. (25) The plant of embodiment 24, wherein the nucleic acid or vector is present on the exterior of the plant. (26) The plant of embodiment 24, wherein the nucleic acid or vector is present in the interior of the plant. (27) The plant of embodiment 26, wherein the nucleic acid or vector is intracellular. (28) The progeny of the plant of embodiment 27. (29) A seed from the plant of either of embodiments 27 or 28. (30) A plant comprising one or more polypeptides according to any of embodiments 10-14. (31) The plant of embodiment 30, wherein the polypeptide is present on the exterior of the plant. (32) The plant of embodiment 30, wherein the polypeptide is present in the interior of the plant. (33) The plant of embodiment 32, wherein the polypeptide is intracellular. (34) A method for modulating pest infestation in a plant, the method comprising contacting a plant or a plant part with a composition comprising one or more nucleic acids according to any of embodiments 1-7 or 15-17, or one or more of the nucleic acid vectors of embodiments 8 or 9, or one or more polypeptides according to any of embodiments 10-14. (35) The method of embodiment 34, wherein said contacting comprises one of the following: (a) applying the composition to the plant; (b) applying the composition to the substrate in which the plant is growing; (c) applying the composition to the root zone of the plant; or (d) dipping the roots of the plant into the composition prior to planting. (36) The method of embodiment 35, wherein said applying comprises one of the following: (a) applying the composition to plants or turf as a soil or root drench; (b) applying via irrigation; or (c) contacting a seed with the composition. (37) The method of embodiment 34, wherein the pest is selected from the group consisting of insects, fungi, nematodes, bacteria and mites. (38) The method of embodiment 34, wherein the composition is applied to the exterior of the plant. (39) The method of embodiment 34, wherein the composition is applied to the interior of the plant. (40) The method of embodiment 39, wherein the nucleic acid or the vector or the polypeptide is intracellular. (41) A pesticidal composition comprising one or more nucleic acids according to any of embodiments 1-7 or 15-17, or a vector according to either of embodiments 8 or 9. (42) A pesticidal composition comprising one or more polypeptides according to any of embodiments 10-14. (43) The pesticidal composition of either of embodiments 41 or 42, wherein the composition is an insecticide. (44) The pesticidal composition of any of embodiments 41-43, further comprising a second pesticide. (45) The pesticidal composition of embodiment 44, wherein the second pesticide is an insecticide. (46) A computer-readable medium comprising the sequence information of any of SEQ ID NOs:1-8960. (47) A computer-readable medium comprising the sequence information of any of the nucleic acids of embodiments 1-7 or 15-17, or the vectors of either of embodiments 8 or 9. (48) A computer-readable medium comprising the sequence information of any of the polypeptides of embodiments 10-14. (49) A nucleic acid that hybridizes, under high-stringency conditions, to the nucleic acid of any of embodiments 1-7 or 15-17. (50) The nucleic acid of any of embodiments 1-7 or 15-17, further comprising a heterologous nucleotide sequence. (51) The nucleic acid of embodiment 50, wherein said heterologous nucleotide sequence is a regulatory sequence. (52) The nucleic acid of embodiment 50, wherein said heterologous nucleotide sequence encodes a heterologous polypeptide. (53) The polypeptide of any of embodiments 10-14, further comprising a heterologous amino acid sequence. (54) An antibody that binds to the polypeptide of any of embodiments 10-14.

Accordingly, disclosed herein, inter alia, are the following embodiments:

DESCRIPTION OF EMBODIMENTS

Practice of the present disclosure employs, unless otherwise indicated, standard methods and conventional techniques in the fields of agriculture, plant molecular biology, entomology, cell biology, molecular biology, biochemistry, recombinant DNA and related fields as are within the skill of the art. Such techniques are described in the literature and thereby available to those of skill in the art. See, for example, Alberts, B. et al., "Molecular Biology of the Cell," 5$^{th}$ edition, Garland Science, New York, N.Y., 2008; Voet, D. et al. "Fundamentals of Biochemistry: Life at the Molecular Level," 3$^{rd}$ edition, John Wiley & Sons, Hoboken, N.J., 2008; Sambrook, J. et al., "Molecular Cloning: A Laboratory Manual," 3$^{rd}$ edition, Cold Spring Harbor Laboratory Press, 2001; Ausubel, F. et al., "Current Protocols in Molecular Biology," John Wiley & Sons, New York, 1987 and periodic updates; Glover, DNA Cloning: A Practical Approach, volumes I and II, IRL Press (1985), volume III, IRL Press (1987); Perbal, A Practical Guide to Molecular Cloning, John Wiley & Sons (1984); Rigby (ed.), The series "Genetic Engineering" (Academic Press); Setlow & Hollaender (eds.), The series "Genetic Engineering: Principles and Methods," Plenum Press; Gait (ed.), Oligonucleotide Synthesis: A Practical Approach, IRL Press (1984, 1985); Eckstein (ed.) Oligonucleotides and Analogues: A Practical Approach, IRL Press (1991); Hames & Higgins, Nucleic Acid Hybridization: A Practical Approach, IRL Press (1985); Hames & Higgins, Transcription and Translation: A Practical Approach, IRL Press (1984); B. Buchanan, W. Gruissem & R. Jones (eds.) "Biochemistry and Molecular Biology of Plants," Wiley (2002) and the series "Methods in Enzymology," Academic Press, San Diego, Calif. The disclosures of all of the foregoing references illustrate methods and compositions in the relevant arts.

Where a range of values is provided, it is understood that each intervening value, to the tenth of the unit of the lower limit unless the context clearly dictates otherwise, between the upper and lower limit of that range and any other stated or intervening value in that stated range, is included therein. Smaller ranges are also included. The upper and lower limits of these smaller ranges are also included therein, subject to any specifically excluded limit in the stated range.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described.

It must be noted that as used herein and in the appended claims, the singular forms "a," and "the" include plural references unless the context clearly dictates otherwise.

Polynucleotides and Oligonucleotides A polynucleotide is a polymer of nucleotides, and the term is meant to embrace smaller polynucleotides (fragments) generated by fragmentation of larger polynucleotides. The terms polynucleotide and nucleic acid encompass both RNA and DNA, as well as single-stranded and double-stranded polynucleotides and nucleic acids. Polynucleotides also include modified polynucleotides and nucleic acids, containing such modifications of the base, sugar or phosphate groups as are known in the art.

An oligonucleotide is a short nucleic acid, generally DNA and generally single-stranded. Generally, an oligonucleotide will be shorter than 200 nucleotides, more particularly, shorter than 100 nucleotides, most particularly, 50 nucleotides or shorter.

Modified bases and base analogues, e.g., those able to form Hoogsteen and reverse Hoogsteen base pairs with the naturally-occurring bases, are known in the art. Examples include, but are not limited to, 8-oxo-adenosine, pseudoisocytidine, 5-methyl cytidine, inosine, 2-aminopurine and various pyrrolo- and pyrazolopyrimidine derivatives. Similarly, modified sugar residues or analogues, for example 2'-O-methylribose or peptide nucleic acid backbones, can also form a component of a modified base or base analogue. See, for example, Sun and Helene (1993) *Curr. Opin. Struct. Biol.* 3:345-356. Non-nucleotide macromolecules capable of any type of sequence-specific interaction with a polynucleotide are useful in the methods and compositions disclosed herein. Examples include, but are not limited to, peptide nucleic acids, minor groove-binding agents and antibiotics. New modified bases, base analogues, modified sugars, sugar analogues, modified phosphates and phosphate analogues capable of participating in duplex or triplex formation are available in the art, and are useful in the methods and compositions disclosed herein.

Homology and Identity of Nucleic Acids and Polypeptides "Homology" or "identity" or "similarity" as used herein in the context of nucleic acids and polypeptides refers to the relationship between two polypeptides or two nucleic acid molecules based on an alignment of the amino acid sequences or nucleic acid sequences, respectively. Homology and identity can each be determined by comparing a position in each sequence which may be aligned for purposes of comparison. For example, a "reference sequence" can be compared with a "test sequence." When a position in the reference sequence is occupied by the same base or amino acid at an equivalent position in the test sequence, then the molecules are identical at that position; when the equivalent position is occupied by a similar amino acid residue (e.g., similar in steric and/or electronic nature), then the molecules can be referred to as homologous (similar) at that position. The relatedness of two sequences, when expressed as a percentage of homology/similarity or identity, is a function of the number of identical or similar amino acids at positions shared by the sequences being compared. In comparing two sequences, the absence of residues (amino acids or nucleic acids) or presence of extra residues, in one sequence as compared to the other, also decreases the identity and homology/similarity.

As used herein, the term "identity" refers to the percentage of identical nucleotide or amino acid residues at corresponding positions in two or more sequences when the sequences are aligned to maximize sequence matching, i.e., taking into account gaps and insertions. Identity can be readily calculated by known methods, including but not limited to those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48: 1073 (1988). Methods to determine identity are designed to give the highest degree of match between the sequences tested. Moreover, methods to determine identity are codified in publicly available computer programs. Computer program methods to determine identity between two sequences include, but are not limited to, the GCG program package (Devereux et al. (1984) *Nucleic Acids Research* 12:387), BLASTP, BLASTN, and FASTA (Altschul et al. (1990) *J. Molec. Biol.* 215:403-410; Altschul et al. (1997) *Nucleic Acids Res.* 25:3389-3402). The BLAST X program is publicly available from NCBI and other sources. See, e.g., BLAST Manual, Altschul, S., et al., NCBI NLM NIH Bethesda, Md. 20894; Altschul et al. (1990) *J. Mol. Biol.* 215:403-410. The well known Smith-Waterman algorithm can also be used to determine identity.

For sequence comparison, typically one sequence acts as a reference sequence, to which one or more test sequences are compared. Sequences are generally aligned for maximum correspondence over a designated region, e.g., a region at least about 20, 25, 30, 35, 40, 45, 50, 55, 60, 65 or more amino acids or nucleotides in length, and the region can be as long as the full-length of the reference amino acid sequence or reference nucleotide sequence. When using a sequence comparison algorithm, test and reference sequences are input into a computer program, subsequence coordinates are designated, if necessary, and sequence algorithm program parameters are designated. The sequence comparison algorithm then calculates the percent sequence identity for the test sequence(s) relative to the reference sequence, based on the designated program parameters.

Examples of algorithms that are suitable for determining percent sequence identity are the BLAST and BLAST 2.0 algorithms, which are described in Altschul et al. (1990) *J. Mol. Biol.* 215:403-410 and Altschul et al. (1977) *Nucleic Acids Res.* 25:3389-3402, respectively. Software for performing BLAST analyses is publicly available through the National Center for Biotechnology Information at www.ncbi.nlm.nih.gov (visited Dec. 27, 2012). Further exemplary algorithms include ClustalW (Higgins et al. (1994) *Nucleic Acids Res.* 22:4673-4680), available at www.ebi.ac.uk/Tools/clustalw/index.html (visited Dec. 27, 2012).

Sequence identity between two nucleic acids can also be described in terms of annealing, reassociation, or hybridization of two polynucleotides to each other, mediated by base-pairing. Hybridization between polynucleotides proceeds according to well-known and art-recognized base-pairing properties, such that adenine base-pairs with thymine or uracil, and guanine base-pairs with cytosine. The property of a nucleotide that allows it to base-pair with a second nucleotide is called complementarity. Thus, adenine is complementary to both thymine and uracil, and vice versa; similarly, guanine is complementary to cytosine and vice versa. An oligonucleotide or polynucleotide which is complementary along its entire length with a target sequence is said to be perfectly complementary, perfectly matched, or fully complementary to the target sequence, and vice versa. Two polynucleotides can have related sequences, wherein the majority of bases in the two sequences are complementary, but one or more bases are noncomplementary, or mismatched. In such a case, the sequences can be said to be substantially complementary to one another. If two polynucleotide sequences are such that they are complementary at all nucleotide positions except one, the sequences have a single nucleotide mismatch with respect to each other.

Conditions for hybridization are well-known to those of skill in the art and can be varied within relatively wide limits. Hybridization stringency refers to the degree to which hybridization conditions disfavor the formation of hybrids containing mismatched nucleotides, thereby promoting the formation of perfectly matched hybrids or hybrids containing fewer mismatches; with higher stringency correlated with a lower tolerance for mismatched hybrids. Factors that affect the stringency of hybridization include, but are not limited to, temperature, pH, ionic strength, and concentration of organic solvents such as formamide and dimethylsulfoxide. As is well known to those of skill in the art, hybridization stringency is increased by higher temperatures, lower ionic strengths, and lower solvent concentrations. See, for example, Ausubel et al., supra; Sambrook et al., supra; M. A. Innis et al. (eds.) PCR Protocols, Academic Press, San Diego, 1990; B. D. Hames et al. (eds.) Nucleic Acid Hybridisation: A Practical Approach, IRL Press, Oxford, 1985; and van Ness et al., (1991) *Nucleic Acids Res.* 19:5143-5151.

Thus, in the formation of hybrids (duplexes) between two polynucleotides, the polynucleotides are incubated together in solution under conditions of temperature, ionic strength, pH, etc., that are favorable to hybridization, i.e., under hybridization conditions. Hybridization conditions are chosen, in some circumstances, to favor hybridization between two nucleic acids having perfectly-matched sequences, as compared to a pair of nucleic acids having one or more mismatches in the hybridizing sequence. In other circumstances, hybridization conditions are chosen to allow hybridization between mismatched sequences, favoring hybridization between nucleic acids having fewer mismatches.

The degree of hybridization between two polynucleotides, also known as hybridization strength, is determined by methods that are well-known in the art. A preferred method is to determine the melting temperature ($T_m$) of the hybrid duplex. This is accomplished, for example, by subjecting a duplex in solution to gradually increasing temperature and monitoring the denaturation of the duplex, for example, by absorbance of ultraviolet light, which increases with the unstacking of base pairs that accompanies denaturation. $T_m$ is generally defined as the temperature midpoint of the transition in ultraviolet absorbance that accompanies denaturation. Alternatively, if $T_m$s are known, a hybridization temperature (at fixed ionic strength, pH and solvent concentration) can be chosen that is below the $T_m$ of the desired duplex and above the $T_m$ of an undesired duplex. In this case, determination of the degree of hybridization is accomplished simply by testing for the presence of duplex polynucleotide.

Hybridization conditions are selected following standard methods in the art. See, for example, Sambrook, et al., Molecular Cloning: A Laboratory Manual, Second Edition, (1989) Cold Spring Harbor, N.Y. For example, hybridization reactions can be conducted under stringent conditions. An example of stringent hybridization conditions is hybridization at 50° C. or higher in 0.1×SSC (15 mM sodium chloride/1.5 mM sodium citrate). Another example of stringent hybridization conditions is overnight incubation at 42° C. in a solution: 50% formamide, 5×SSC (0.75 M NaCl, 75 mM trisodium citrate), 50 mM sodium phosphate (pH7.6), followed by washing in 0.1×SSC at about 65° C. Optionally, one or more of 5× Denhardt's solution, 10% dextran sulfate, and/or 20 mg/ml heterologous nucleic acid (e.g., yeast tRNA, denatured, sheared salmon sperm DNA) can be included in a hybridization reaction. Stringent hybridization conditions are hybridization conditions that are at least as stringent as the above representative conditions, where conditions are considered to be at least as stringent if they are at least about 80% as stringent, typically at least 90% as stringent as the above specific stringent conditions.

The term "substantially identical" refers to identity between a first amino acid sequence that contains a sufficient or minimum number of amino acid residues that are i) identical to, or ii) conservative substitutions of, aligned amino acid residues in a second amino acid sequence such that the first and second amino acid sequences share a common structural domain and/or common functional activity. For example, amino acid sequences that contain a common structural domain having at least about 90%, 91%, 92%, 93%, 94%, 95%, 96%, 97%, 98%, 99% or 99.5% identity to an amino acid sequence as disclosed herein (i.e., SEQ ID NOs:4534-8960) are termed substantially identical. In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional or structural activity, or encode a common structural polypeptide domain or a common functional polypeptide activity.

The term "homology" describes a mathematically based comparison of sequence similarities which is used to identify genes or proteins with similar functions or motifs. A reference nucleotide or amino acid sequence (e.g., a sequence as disclosed herein) is used as a "query sequence" to perform a search against public databases to, for example, identify other family members, related sequences or homologues. Such searches can be performed using the NBLAST and XBLAST programs (version 2.0) of Altschul et al. (1990) *J. Mol. Biol.* 215:403-410. BLAST nucleotide searches can be performed with the NBLAST program, score=100, wordlength=12 to obtain nucleotide sequences homologous to a reference nucleotide sequence. BLAST amino acid searches can be performed with the XBLAST program, score=50, wordlength=3 to obtain amino acid sequences homologous to a reference amino acid sequence. To obtain gapped alignments for comparison purposes, Gapped BLAST can be utilized as described in Altschul et al. (1997) *Nucleic Acids Res.* 25:3389-3402. When utilizing the BLAST and Gapped BLAST programs, the default parameters of the respective programs (e.g., XBLAST and BLAST) can be used (see the world wide web at: ncbi.nlm.nih.gov).

Nucleic acids and polynucleotides of the present disclosure encompass those having an nucleotide sequence that is at least 75%, at least 80%, at least 90%, at least 95%, at least 99% or 100% identical to any of SEQ ID NOs:2-4533.

Nucleotide analogues and amino acid analogues are known in the art. Accordingly, nucleic acids (i.e., SEQ ID NOs:1-4533X) comprising nucleotide analogues and polypeptides (i.e., SEQ ID NOs:4534-8960) comprising amino acid analogues are also encompassed by the present disclosure.

Conservative Substitutions and Functional Fragments In comparing amino acid sequences, residue positions which are not identical can differ by conservative amino acid substitutions. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. With respect to a reference polypeptide sequence, a test polypeptide sequence that differs only by conservative substitutions is denoted a "conservatively substituted variant" of the reference sequence.

A "functional fragment" of a protein, polypeptide or nucleic acid is a protein, polypeptide or nucleic acid whose sequence is not identical to the full-length protein, polypeptide or nucleic acid, yet retains the same function as the full-length protein, polypeptide or nucleic acid. A functional fragment can possess more, fewer, or the same number of residues as the corresponding native molecule, and/or can contain one ore more amino acid or nucleotide substitutions. Methods for determining the function of a nucleic acid (e.g., coding function, ability to hybridize to another nucleic acid) are well-known in the art. Similarly, methods for determining protein function are well-known. For example, the DNA-binding function of a polypeptide can be determined, for example, by filter-binding, electrophoretic mobility-shift, or immunoprecipitation assays. See Ausubel et al., supra. The ability of a protein to interact with another protein can be determined, for example, by co-immunoprecipitation, two-hybrid assays or complementation, either genetic and biochemical. See, for example, Fields et al. (1989) *Nature* 340:245 246; U.S. Pat. No. 5,585,245 and PCT WO 98/44350.

Typically, a functional fragment retains at least 50% of the activity or function of the polypeptide. In some embodiments, a functional fragment retains at least 60%, at least 70%, at least 80%, at least 90%, at least 95%, at least 99% or 100% of the activity or function of the polypeptide.

A functional fragment of a polypeptide can include conservative amino acid substitutions (with respect to the native polypeptide sequence) that do not substantially alter the activity or function of the polypeptide. The term "conservative amino acid substitution" refers to grouping of amino acids on the basis of certain common structures and/or properties. With respect to common structures, amino acids can be grouped into those with non-polar side chains (glycine, alanine, valine, leucine, isoleucine, methionine, proline, phenylalanine and tryptophan), those with uncharged polar side chains (serine, threonine, asparagine, glutamine, tyrosine and cysteine) and those with charged polar side chains (lysine, arginine, aspartic acid, glutamic acid and histidine). A group of amino acids containing aromatic side chains includes phenylalanine, tryptophan and tyrosine. Heterocyclic side chains are present in proline, tryptophan and histidine. Within the group of amino acids containing non-polar side chains, those with short hydrocarbon side chains (glycine, alanine, valine. leucine, isoleucine) can be distinguished from those with longer, non-hydrocarbon side chains (methionine, proline, phenylalanine, tryptophan). Within the group of amino acids with charged polar side chains, the acidic amino acids (aspartic acid, glutamic acid) can be distinguished from those with basic side chains (lysine, arginine and histidine).

A functional method for defining common properties of individual amino acids is to analyze the normalized frequencies of amino acid changes between corresponding proteins of homologous organisms (Schulz, G. E. and R. H.

Schirmer, Principles of Protein Structure, Springer-Verlag, 1979). According to such analyses, groups of amino acids can be defined in which amino acids within a group are preferentially substituted for one another in homologous proteins, and therefore have similar impact on overall protein structure (Schulz, G. E. and R. H. Schirmer, supra). According to this type of analysis, conservative amino acid substitution" refers to a substitution of one amino acid residue for another sharing chemical and physical properties of the amino acid side chain (e.g., charge, size, hydrophobicity/hydrophilicity). Following are examples of amino acid residues sharing certain chemical and/or physical properties: (i) amino acids containing a charged group, consisting of Glu, Asp, Lys, Arg and His, (ii) amino acids containing a positively-charged group, consisting of Lys, Arg and His, (iii) amino acids containing a negatively-charged group, consisting of Glu and Asp, (iv) amino acids containing an aromatic group, consisting of Phe, Tyr and Trp, (v) amino acids containing a nitrogen ring group, consisting of His and Trp, (vi) amino acids containing a large aliphatic non-polar group, consisting of Val, Leu and Ile, (vii) amino acids containing a slightly-polar group, consisting of Met and Cys, (viii) amino acids containing a small-residue group, consisting of Ser, Thr, Asp, Asn, Gly, Ala, Glu, Gln and Pro, (ix) amino acids containing an aliphatic group consisting of Val, Leu, Ile, Met and Cys, and (x) amino acids containing a hydroxyl group consisting of Ser and Thr.

Certain "conservative substitutions" may include substitution within the following groups of amino acid residues: gly, ala; val, ile, leu; asp, glu; asn, gln; ser, thr; lys, arg; and phe, tyr.

Thus, as exemplified above, conservative substitutions of amino acids are known to those of skill in this art and can be made generally without altering the biological activity or function of the resulting molecule. Those of skill in this art also recognize that, in general, single amino acid substitutions in non-essential regions of a polypeptide do not substantially alter biological activity. See, e.g., Watson, et al., "Molecular Biology of the Gene," 4th Edition, 1987, The Benjamin/Cummings Pub. Co., Menlo Park, Calif., p. 224.

Polypeptides of the present disclosure encompass those having 1, 2, 3, 4, 5, 6, 7, 8, 9 or 10 or more amino acid substitutions compared to an amino acid sequence as set forth in SEQ ID NOs:4534-8960, e.g., conservative amino acid substitutions. Amino acid residues that can be substituted can be located at residue positions that are not highly conserved. The ordinarily skilled artisan will appreciate that, based on location of the active sites and/or on homology to related proteins, a protein will tolerate substitutions, deletions, and/or insertions at certain of its amino acid residues, without significant change in its overall physical and chemical properties.

Polypeptides of the present disclosure encompass those having an amino acid sequence that is at least 75%, at least 80%, at least 90%, at least 95%, at least 99% or 100% identical to any of the polypeptides shown in SEQ ID NOs:4534-8960.

*C. subtsugae* nucleic acids The present disclosure provides the entire nucleotide sequence of the *C. subtsugae* genome (SEQ ID NO:1). This genome contains 4,705,004 bp, which includes 4,415 protein-coding sequences (i.e., open reading frames or ORFs) and 118 functional RNA sequences.

Also provided are nucleotide sequences of open reading frames (ORFs) encoding *C. subtsugae* genes and nucleotide sequences of functional RNA molecules (e.g., rRNAs, tRNAs) (SEQ ID NOs:2-4533) as disclosed in Table 1. Nucleic acids comprising these sequences are also provided. Fragments of the *C. subtsugae* genome and/or fragments of *C. subtsugae* gene sequences are also provided. Such fragments are 10 or more, 25 or more, 50 or more, 75 or more, 100 or more 200 or more, 500 or more, or 1,000 or more nucleotides in length. Nucleic acids having a sequence that is 50%, 55%, 60%, 65%, 70%, 75%, 80%, 85%, 90%, 95%, 96%, 97%, 98%, 99% or 99.9% identical to the aforementioned sequences are also provided. The nucleic acids disclosed herein can be either DNA or RNA, and can be either single-stranded or double-stranded. Nucleic acids comprising nucleotide sequences that are complementary to the aforementioned sequences are also provided, as are nucleic acids that hybridize to the aforementioned nucleic acids under stringent conditions.

Fragments of the *C. subtsugae* genome that encode polypeptides (i.e., open reading frames or ORFs) are provided. *C. subtsugae* ORFs encode secreted proteins that include, inter alia, proteases, chitinases, rhs (rearrangement hotspot) proteins, lipases, phospholipases, esterases, toxins, proteins involved in iron metabolism, proteins involved in phosphate metabolism, proteins involved in plant growth, and proteins involved in biosynthesis of fimbria and pili. Genome fragments that encode protein clusters, e.g., those involved in non-ribosomal peptide synthesis (NRPS), and other biosynthetic clusters, are also provided. *C. subtsugae* ORFs also encode transmembrane proteins that include, inter alia, transporters, proteases, toxins, antibiotics and proteins that confer antibiotic resistance. Additional fragments of the *C. subtsugae* genome encode functional RNA molecules, such as, for example, rRNAs and tRNAs. Yet additional fragments of the *C. subtsugae* genome comprise transcriptional and translational regulatory sequences such as promoters, operators, terminators ribosome binding sites, etc.

Additional *C. subtsugae* ORFs encode proteins that confer insecticide activity, miticide activity, nematicide activity, algaecide activity or can be used in bioremediation methods.

Additional *C. subtsugae* ORFs encode proteins that participate in the synthesis of metabolites that confer insecticide activity, miticide activity, nematicide activity, algaecide activity or can be used in bioremediation methods.

The subject nucleic acids can optionally comprise heterologous nucleotide sequences. Such heterologous nucleotide sequences can be regulatory sequences, such as promoters, operators, enhancers, terminators and the like; or can encode heterologous amino acid (i.e., polypeptide) sequences.

For example, a heterologous regulatory sequence can be joined in operative linkage to a *C. subtsugae* protein-encoding sequence (i.e. ORF) to provide regulated expression of a *C. subtsugae* protein. Such constructs can be used, e.g., for regulated expression and/or overexpression of pesticidal *C. subtsugae* proteins (e.g., chitinases, lipases, proteases) in a host cell. Such constructs can also be used for regulated expression and/or overexpression of an enzyme encoded by the *C. subtsugae* genome that catalyzes the synthesis of a pesticidal metabolite (or an intermediate in the synthesis of a pesticidal metabolite). Host cells can be chosen to facilitate expression and/or purification of cloned *C. subtsugae* proteins.

In additional embodiments, a *C. subtsugae* regulatory sequence can be joined in operative linkage with a heterologous coding sequence (e.g., ORF) to provide regulated expression of a heterologous protein in, e.g., *C. subtsugae* or another host. Such a protein can be for example, a pesticidal protein not encoded by the *C. subtsugae* genome or an enzyme that catalyzes the synthesis of a pesticidal metabolite. Such an enzyme can be encoded by the *C. subtsugae* genome or encoded by a heterologous organism.

The present disclosure also provides polynucleotides comprising a nucleotide sequence encoding any of the polypeptide sequences disclosed herein. Such a polynucleotide has a nucleotide sequence that is at least 70% (e.g., at least 75%, at least 80%, at least 85%, at least 90%, at least 95%, at least 98%, at least 99% or 100%) identical to a contiguous sequence of a nucleic acid that encodes any of the polypeptides disclosed herein. The percentage identity is based on the shorter of the sequences compared. Well known programs such as BLASTN (2.0.8) (Altschul et al. (1997) *Nucl. Acids. Res.* 25:3389-3402) using default parameters and no filter can be employed to make a sequence comparison. Nucleic acid sequence identity (e.g. between two different polynucleotides encoding identical amino acid sequences) can be lower than the percent of amino acid sequence identity due to degeneracy of the genetic code.

Examples of nucleic acid sequences in a polynucleotide encoding a polypeptide of the present disclosure can be found among SEQ ID NOs:2-4533. These nucleic acid sequences can also be provided in an expression vector (see below).

*C. subtsugae* polypeptides and proteins The present disclosure provides the amino acid sequences of proteins encoded by the *C. subtsugae* genome, as well as polypeptides comprising said amino acid sequences (i.e., SEQ ID NOs:4534-8960). Functional fragments and conservatively-substituted variants of said polypeptides are also provided. In addition, fragments of the polypeptides disclosed herein that do not retain function are also provided and are useful, e.g., as epitopes for production of antibodies. Such fragments are 4 or more, 10 or more, 25 or more, 50 or more, 75 or more, 100 or more 200 or more, 500 or more, or 1,000 or more amino acids in length.

The present disclosure also provides a polypeptide comprising an amino acid sequence that is at least 50%, 55%, 60%, 65%, 70%, 75%, 80%, 85%, 90%, 95%, 96%, 97%, 98%, 99% or 99.5% identical to a contiguous sequence of a polypeptide as disclosed herein. The percentage identity is based on the shorter of the sequences compared. Methods for determining degree of polypeptide sequence identity are well-known in the art.

The subject polypeptides can include amino acid sequences derived from any of SEQ ID NOs:4534-8960 further comprising heterologous amino acid sequences. Such polypeptides can be fusion proteins, such as a fusion protein containing epitope tags, purification tags, and/or detectable labels. A fusion protein can optionally include a linker sequence between the heterologous sequences and the *C. subtsugae* amino acid sequence. Methods for producing fusion proteins are well-known in the art. Other heterologous elements and exemplary fusion proteins are described in more detail below.

Exemplary polypeptides containing heterologous elements may include myc and/or $His_6$ tags and may optionally include flanking linker sequences.

Polypeptides of the present disclosure further encompass those that are joined to a reporter polypeptide, e.g., a fluorescent protein, and/or conjugated to a molecule. The molecule conjugated to the polypeptide can be a carrier molecule or a moiety that facilitates delivery and/or increases the half-life of the subject polypeptide.

Polypeptides of the present disclosure can be produced by any suitable method, including recombinant and non-recombinant methods (e.g., chemical synthesis). The subject polypeptide can be prepared by solid-phase synthesis methods well-known in the art, (e.g., Fmoc- or t-Boc chemistry), such as those described by Merrifield (1963) *J. Am. Chem. Soc.* 85:2149 and Methods in Molecular Biology, Vol 35: Peptide Synthesis Protocols.

It should be noted that the polypeptides of the present disclosure can also contain additional elements, such as a detectable label, e.g., a radioactive label, a fluorescent label, a biotin label, an immunologically detectable label (e.g., a hemagglutinin (HA) tag, a poly-Histidine tag) and the like. Additional elements can be provided (e.g., in the form of fusion polypeptides) to facilitate expression (e.g. N-terminal methionine and/or a heterologous signal sequence to facilitate expression in host cells), and/or isolation (e.g., biotin tag, immunologically detectable tag) of the polypeptides of the disclosure through various methods. The polypeptides can also optionally be immobilized on a support through covalent or non-covalent attachment.

Isolation and purification of the subject polypeptides can be accomplished according to methods known in the art. The term "isolated" is intended to mean that a compound (e.g. polypeptide or polynucleotide) is separated from all or some of the components that accompany it in nature. "Isolated" also refers to the state of a compound separated from all or some of the components that accompany it during manufacture (e.g., chemical synthesis, recombinant expression, culture medium, and the like).

For example, a polypeptide according to the present disclosure can be isolated from a lysate of cells that have been genetically modified to express the subject polypeptide, from a cell culture medium, or from a synthetic reaction mixture. Isolation can additionally be achieved by immunoaffinity purification, which generally involves contacting a sample with an antibody (optionally immobilized) that specifically binds to an epitope of the polypeptide, washing to remove non-specifically bound material, and eluting specifically bound polypeptide. Isolated polypeptide can be further purified by dialysis and other methods normally employed in protein purification, e.g. metal chelate chromatography, ion-exchange, and size exclusion.

Secreted proteins *C. subtsugae* sequences were examined for the presence of a signal sequence, indicative of secreted proteins. *C. subtsugae* proteins containing a signal sequence are disclosed in this section.

Tables 2-4 provide examples of *C. subtsugae* ORFs encoding potentially secreted proteins known to act against insects.

TABLE 2

| Proteases | |
|---|---|
| CDS ID | Function |
| fig\|6666666.22288.peg.160 | Zn-dependent protease with chaperone function |
| fig\|6666666.22288.peg.173 | Probable endonuclease |
| fig\|6666666.22288.peg.176 | Bacterial leucyl aminopeptidase (EC 3.4.11.10) |
| fig\|6666666.22288.peg.1274 | Putative peptidase |
| fig\|6666666.22288.peg.1991 | Probable protease |
| fig\|6666666.22288.peg.1992 | Probable protease |
| fig\|6666666.22288.peg.2084 | HtrA protease/chaperone protein |
| fig\|6666666.22288.peg.2155 | Putative extracellular serine protease |
| fig\|6666666.22288.peg.2281 | Cell wall endopeptidase, family M23/M37 |
| fig\|6666666.22288.peg.2516 | Probable Peptidase |

TABLE 2-continued

| Proteases | |
|---|---|
| CDS ID | Function |
| fig\|6666666.22288.peg.2583 | LasA protease precursor |
| fig\|6666666.22288.peg.2594 | Dipeptidyl aminopeptidases/ acylaminoacyl-peptidases |
| fig\|6666666.22288.peg.3226 | Tricorn protease homolog (EC 3.4.21.—) |
| fig\|6666666.22288.peg.3193 | Murein-DD-endopeptidase (EC 3.4.99.—) |
| fig\|6666666.22288.peg.3559 | Prolyl endopeptidase (EC 3.4.21.26) |
| fig\|6666666.22288.peg.3563 | Probable protease precursor |
| fig\|6666666.22288.peg.3576 | Possible periplasmic aspartyl protease |
| fig\|6666666.22288.peg.3897 | Putative protease ydgD (EC 3.4.21.—) |
| fig\|6666666.22288.peg.4266 | Zinc protease(EC: 3.4.99.—) |
| fig\|6666666.22288.peg.4323 | Probable metallopeptidase |
| fig\|6666666.22288.peg.175 | Vibriolysin, extracellular zinc protease (EC 3.4.24.25) |
| fig\|6666666.22288.peg.452 | Exported zinc metalloprotease YfgC precursor |
| fig\|6666666.22288.peg.1216 | D-alanyl-D-alanine carboxypeptidase (EC 3.4.16.4) |
| fig\|6666666.22288.peg.2125 | Metallopeptidase |
| fig\|6666666.22288.peg.2670 | Microbial collagenase, secreted (EC 3.4.24.3) |
| fig\|6666666.22288.peg.3292 | Microbial collagenase, secreted (EC 3.4.24.3) |
| fig\|6666666.22288.peg.3131 | D-alanyl-D-alanine carboxypeptidase (EC 3.4.16.4) |

TABLE 3

| Chitinases | |
|---|---|
| CDS ID | Function |
| fig\|6666666.22288.peg.75 | N-acetylglucosamine-regulated outer membrane porin |
| fig\|6666666.22288.peg.893 | Chitosanase precursor (EC 3.2.1.132) |
| fig\|6666666.22288.peg.1535 | Beta-hexosaminidase (EC 3.2.1.52) |
| fig\|6666666.22288.peg.2867 | Chitooligosaccharide deacetylase (EC 3.5.1.—) |
| fig\|6666666.22288.peg.2995 | Chitinase (EC 3.2.1.14) |
| fig\|6666666.22288.peg.3355 | Chitodextrinase precursor (EC 3.2.1.14) |
| fig\|6666666.22288.peg.4392 | Chitinase (EC 3.2.1.14) |
| fig\|6666666.22288.peg.2782 | Endoglucanase precursor (EC 3.2.1.4) |

TABLE 4

| Lipases, phospholipases and esterases | |
|---|---|
| CDS ID | Function |
| fig\|6666666.22288.peg.1665 | Esterase/lipase |
| fig\|6666666.22288.peg.1695 | Lipase/acylhydrolase, putative |
| fig\|6666666.22288.peg.2171 | Lipase precursor (EC 3.1.1.3) |
| fig\|6666666.22288.peg.2172 | Lipase chaperone |

Table 5 provides examples of *C. subtsugae* ORFs encoding secreted proteins with homology to various insect toxins.

TABLE 5

| Toxins | |
|---|---|
| CDS ID | Function |
| fig\|6666666.22288.peg.1582 | Channel-forming transporter/cytolysins activator of TpsB family |
| fig\|6666666.22288.peg.1948 | Channel-forming transporter/cytolysins activator of TpsB family |
| fig\|6666666.22288.peg.341 | Probable thermolabile hemolysin |

TABLE 5-continued

| Toxins | |
|---|---|
| CDS ID | Function |
| fig\|6666666.22288.peg.343 | Phospholipase/lecithinase/hemolysin |
| fig\|6666666.22288.peg.670 | 21 kDa hemolysin precursor |

Table 6 provides examples of *C. subtsugae* ORFs encoding potentially secreted proteins with effects on insect metabolism.

TABLE 6

| Genes encoding proteins involved in iron acquisition and transport | |
|---|---|
| CDS ID | Function |
| fig\|6666666.22288.peg.541 | Periplasmic protein p19 involved in high-affinity Fe2+ transport |
| fig\|6666666.22288.peg.1533 | TonB-dependent receptor; Outer membrane receptor for ferrienterochelin and colicins |
| fig\|6666666.22288.peg.1540 | Ferric iron ABC transporter, iron-binding protein |
| fig\|6666666.22288.peg.1690 | ABC transporter (iron.B12.siderophore.hemin), periplasmic |
| fig\|6666666.22288.peg.1735 | ABC-type Fe3+ transport system, periplasmic component |
| fig\|6666666.22288.peg.3202 | Iron(III)-binding periplasmic protein SfuA/Thiamin ABC transporter, substrate-binding |
| fig\|6666666.22288.peg.3933 | TonB-dependent hemin, ferrichrome receptor |
| fig\|6666666.22288.peg.3935 | Periplasmic hemin-binding protein |

Table 7 provides examples of *C. subtsugae* ORFs encoding potentially secreted proteins with effects on plant growth promotion

TABLE 7

| CDS ID | Function |
|---|---|
| fig\|6666666.22288.peg.1092 | Polyamine Metabolism |
| fig\|6666666.22288.peg.1500 | Arginine and Ornithine Degradation, Polyamine Metabolism |
| fig\|6666666.22288.peg.1984 | GABA and putrescine metabolism from cluters, Polyamine Metabolism |
| fig\|6666666.22288.peg.1987 | Putrescine utilization pathways |
| fig\|6666666.22288.peg.3123 | Arginine and Ornithine Degradation |
| fig\|6666666.22288.peg.4138 | Polyamine Metabolism |
| fig\|6666666.22288.peg.4415 | Polyamine Metabolism |

Table 8 provides an example of a *C. subtsugae* ORF encoding a secreted protein involved in degradation of organic phosphate. Such proteins are useful, for example, for bioremediation.

TABLE 8

| CDS ID | Function |
|---|---|
| fig\|6666666.22288.peg.1492 | Methyl parathion hydrolase (EC: 3.5.—) |

Genes involved in synthesis of pili and fimbriae Table 9 provides examples of *C. subtsugae* ORFs encoding proteins with possible involvement in host interactions, in particular, biogenesis of pili and fimbriae. Some of these proteins contain a signal peptide (as indicated in the right-most column of the table) and are therefore likely to be secreted. Others, which do not contain a signal sequence, may be intracellular or transmembrane proteins.

TABLE 9

| Fimbrial and Type IV Pilus Genes | | |
|---|---|---|
| CDS ID | Function | Signal peptide |
| fig\|6666666.22288.peg.520 | Type IV pilus biogenesis protein PilQ | Yes |
| fig\|6666666.22288.peg.1297 | Fimbrial subunit protein | Yes |
| fig\|6666666.22288.peg.3157 | Type IV fimbrial biogenesis protein PilY1 | Yes |
| fig\|6666666.22288.peg.488 | Type IV fimbrial biogenesis protein FimT | No |
| fig\|6666666.22288.peg.489 | Type IV pilus biogenesis protein PilE | No |
| fig\|6666666.22288.peg.490 | Type IV fimbrial biogenesis protein PilY1 | No |
| fig\|6666666.22288.peg.491 | Type IV fimbrial biogenesis protein PilX | No |
| fig\|6666666.22288.peg.492 | Type IV fimbrial biogenesis protein PilW | No |
| fig\|6666666.22288.peg.493 | Type IV fimbrial biogenesis protein PilV | No |
| fig\|6666666.22288.peg.519 | Type IV pilus biogenesis protein PilP | No |

Transmembrane proteins *C. subtsugae* sequences were examined for the presence of a transmembrane domain, indicative of proteins that are displayed on the cell surface. *C. subtsugae* proteins containing a transmembrane domain are disclosed in this section.

Table 10 provides examples of *C. subtsugae* ORFs encoding transmembrane transporter proteins.

TABLE 10

| Transmembrane Transporters | |
|---|---|
| ID | Protein |
| fig\|6666666.22288.peg.24 | Permease of the drug/metabolite transporter (DMT) superfamily |
| fig\|6666666.22288.peg.77 | Chitobiose ABC transport system, permease protein 1 |
| fig\|6666666.22288.peg.78 | probable ABC transporter sugar permease |
| fig\|6666666.22288.peg.110 | Permease of the drug/metabolite transporter (DMT) superfamily |
| fig\|6666666.22288.peg.143 | Benzoate transport protein |
| fig\|6666666.22288.peg.185 | probable transport transmembrane protein |
| fig\|6666666.22288.peg.193 | Ammonium transporter |
| fig\|6666666.22288.peg.249 | Glutamate Aspartate transport system permease protein GltK (TC 3.A.1.3.4) |
| fig\|6666666.22288.peg.250 | Glutamate Aspartate transport system permease protein GltJ (TC 3.A.1.3.4) |
| fig\|6666666.22288.peg.251 | Glutamate Aspartate periplasmic binding protein precursor GltI (TC 3.A.1.3.4) |
| fig\|6666666.22288.peg.259 | Putative TolA protein |
| fig\|6666666.22288.peg.260 | Tol biopolymer transport system, TolR protein |
| fig\|6666666.22288.peg.339 | RND efflux system, inner membrane transporter CmeB |
| fig\|6666666.22288.peg.344 | Arsenic efflux pump protein |
| fig\|6666666.22288.peg.376 | Biopolymer transport protein ExbD/TolR |
| fig\|6666666.22288.peg.382 | COG0477: Permeases of the major facilitator superfamily |
| fig\|6666666.22288.peg.393 | RND efflux system, inner membrane transporter CmeB |
| fig\|6666666.22288.peg.400 | RND efflux system, inner membrane transporter CmeB |
| fig\|6666666.22288.peg.404 | ABC-type multidrug transport system, permease component |
| fig\|6666666.22288.peg.411 | Uncharacterized ABC transporter, periplasmic component YrbD |
| fig\|6666666.22288.peg.412 | Uncharacterized ABC transporter, permease component YrbE |
| fig\|6666666.22288.peg.416 | Permeases of the drug/metabolite transporter (DMT) superfamily |
| fig\|6666666.22288.peg.422 | Histidine permease YuiF |
| fig\|6666666.22288.peg.462 | Permeases of the major facilitator superfamily |
| fig\|6666666.22288.peg.465 | probable MFS transporter |
| fig\|6666666.22288.peg.496 | major facilitator superfamily MFS_1 |
| fig\|6666666.22288.peg.502 | MFS transporter |
| fig\|6666666.22288.peg.512 | Putative preQ0 transporter |
| fig\|6666666.22288.peg.528 | Lipid A export ATP-binding/permease protein MsbA (EC 3.6.3.25) |
| fig\|6666666.22288.peg.585 | Permease of the drug/metabolite transporter (DMT) superfamily |
| fig\|6666666.22288.peg.616 | major facilitator superfamily MFS_1 |
| fig\|6666666.22288.peg.622 | Major facilitator superfamily |
| fig\|6666666.22288.peg.697 | ABC superfamily (ATP-binding membrane) transport protein |
| fig\|6666666.22288.peg.703 | Twin-arginine translocation protein TatC |
| fig\|6666666.22288.peg.705 | Twin-arginine translocation protein TatA |
| fig\|6666666.22288.peg.748 | Manganese transport protein MntH |
| fig\|6666666.22288.peg.771 | Permease of the drug/metabolite transporter (DMT) superfamily |
| fig\|6666666.22288.peg.809 | Histidine ABC transporter, permease protein HisQ (TC 3.A.1.3.1) |
| fig\|6666666.22288.peg.810 | Histidine ABC transporter, permease protein HisM (TC 3.A.1.3.1) |
| fig\|6666666.22288.peg.823 | Amino acid transporter |
| fig\|6666666.22288.peg.850 | Acetate permease ActP (cation/acetate symporter) |
| fig\|6666666.22288.peg.862 | TRAP-type C4-dicarboxylate transport system, large permease component |
| fig\|6666666.22288.peg.863 | TRAP-type transport system, small permease component, predicted N-acetylneuraminate transporter |
| fig\|6666666.22288.peg.903 | Sodium/glutamate symport protein |
| fig\|6666666.22288.peg.910 | Dipeptide transport system permease protein DppC (TC 3.A.1.5.2) |
| fig\|6666666.22288.peg.911 | Dipeptide transport system permease protein DppB (TC 3.A.1.5.2) |

TABLE 10-continued

| Transmembrane Transporters | |
|---|---|
| ID | Protein |
| fig\|6666666.22288.peg.912 | Dipeptide-binding ABC transporter, periplasmic substrate-binding component (TC 3.A.1.5.2) |
| fig\|6666666.22288.peg.965 | Permeases of the major facilitator superfamily |
| fig\|6666666.22288.peg.1022 | 4-hydroxybenzoate transporter |
| fig\|6666666.22288.peg.1080 | Phosphate transport system permease protein PstC (TC 3.A.1.7.1) |
| fig\|6666666.22288.peg.1081 | Phosphate transport system permease protein PstA (TC 3.A.1.7.1) |
| fig\|6666666.22288.peg.1084 | Low-affinity inorganic phosphate transporter |
| fig\|6666666.22288.peg.1149 | Ethanolamine permease |
| fig\|6666666.22288.peg.1155 | probable multidrug resistance protein |
| fig\|6666666.22288.peg.1167 | probable MFS transporter |
| fig\|6666666.22288.peg.1175 | Di-/tripeptide transporter |
| fig\|6666666.22288.peg.1183 | Lead, cadmium, zinc and mercury transporting ATPase (EC 3.6.3.3) (EC 3.6.3.5); Copper-translocating P-type ATPase (EC 3.6.3.4) |
| fig\|6666666.22288.peg.1201 | D-serine/D-alanine/glycine transporter |
| fig\|6666666.22288.peg.1205 | Permease of the drug/metabolite transporter (DMT) superfamily |
| fig\|6666666.22288.peg.1221 | Chromate transport protein ChrA |
| fig\|6666666.22288.peg.1222 | Chromate transport protein ChrA |
| fig\|6666666.22288.peg.1232 | Kef-type K+ transport systems, predicted NAD-binding component |
| fig\|6666666.22288.peg.1236 | Nitrate/nitrite transporter |
| fig\|6666666.22288.peg.1267 | Magnesium and cobalt transport protein CorA |
| fig\|6666666.22288.peg.1275 | Chromate transport protein ChrA |
| fig\|6666666.22288.peg.1276 | probable permease of ABC transporter |
| fig\|6666666.22288.peg.1282 | Spermidine export protein MdtI |
| fig\|6666666.22288.peg.1283 | Spermidine export protein MdtJ |
| fig\|6666666.22288.peg.1302 | Permeases of the major facilitator superfamily |
| fig\|6666666.22288.peg.1377 | Protein-export membrane protein SecF (TC 3.A.5.1.1) |
| fig\|6666666.22288.peg.1378 | Protein-export membrane protein SecD (TC 3.A.5.1.1) |
| fig\|6666666.22288.peg.1436 | Permease of the drug/metabolite transporter (DMT) superfamily |
| fig\|6666666.22288.peg.1460 | probable homoserine/homoserine lactone efflux protein |
| fig\|6666666.22288.peg.1463 | Serine transporter |
| fig\|6666666.22288.peg.1464 | Formate efflux transporter (TC 2.A.44 family) |
| fig\|6666666.22288.peg.1478 | Major facilitator superfamily precursor |
| fig\|6666666.22288.peg.1530 | Iron(III) dicitrate transport system permease protein FecD (TC 3.A.1.14.1) |
| fig\|6666666.22288.peg.1539 | Ferric iron ABC transporter, permease protein |
| fig\|6666666.22288.peg.1549 | High-affinity branched-chain amino acid transport system permease protein LivH (TC 3.A.1.4.1) |
| fig\|6666666.22288.peg.1550 | Branched-chain amino acid transport system permease protein LivM (TC 3.A.1.4.1) |
| fig\|6666666.22288.peg.1567 | Zinc ABC transporter, inner membrane permease protein ZnuB |
| fig\|6666666.22288.peg.1609 | Probable Co/Zn/Cd efflux system membrane fusion protein |
| fig\|6666666.22288.peg.1610 | RND multidrug efflux transporter; Acriflavin resistance protein |
| fig\|6666666.22288.peg.1620 | Drug resistance transporter EmrB/QacA subfamily |
| fig\|6666666.22288.peg.1643 | Putative sulfate permease |
| fig\|6666666.22288.peg.1645 | Potassium-transporting ATPase A chain (EC 3.6.3.12) (TC 3.A.3.7.1) |
| fig\|6666666.22288.peg.1646 | Potassium-transporting ATPase B chain (EC 3.6.3.12) (TC 3.A.3.7.1) |
| fig\|6666666.22288.peg.1647 | Potassium-transporting ATPase C chain (EC 3.6.3.12) (TC 3.A.3.7.1) |
| fig\|6666666.22288.peg.1675 | HoxN/HupN/NixA family cobalt transporter |
| fig\|6666666.22288.peg.1691 | ABC transporter (iron.B12.siderophore.hemin), permease component |
| fig\|6666666.22288.peg.1723 | Putative sodium-dependent transporter |
| fig\|6666666.22288.peg.1733 | Thiamin ABC transporter, transmembrane component |
| fig\|6666666.22288.peg.1734 | ABC transporter permease protein |
| fig\|6666666.22288.peg.1785 | Sulfate permease |
| fig\|6666666.22288.peg.1791 | Putative 10 TMS drug/metabolite exporter, DME family, DMT superfamily |
| fig\|6666666.22288.peg.1827 | Permease of the drug/metabolite transporter (DMT) superfamily |
| fig\|6666666.22288.peg.1845 | putative hemin permease |
| fig\|6666666.22288.peg.1869 | Permeases of the major facilitator superfamily |
| fig\|6666666.22288.peg.1876 | Sulfate transport system permease protein CysW |
| fig\|6666666.22288.peg.1877 | Sulfate transport system permease protein CysT |
| fig\|6666666.22288.peg.1905 | Ferric iron ABC transporter, permease protein |
| fig\|6666666.22288.peg.1925 | Putative transport protein |
| fig\|6666666.22288.peg.1936 | Transporter, LysE family |
| fig\|6666666.22288.peg.1939 | Permease of the drug/metabolite transporter (DMT) superfamily |
| fig\|6666666.22288.peg.1960 | Nucleoside permease NupC |
| fig\|6666666.22288.peg.1966 | Transporter, LysE family |
| fig\|6666666.22288.peg.1985 | Putrescine transport system permease protein PotH (TC 3.A.1.11.2) |
| fig\|6666666.22288.peg.1986 | Putrescine transport system permease protein PotI (TC 3.A.1.11.2) |
| fig\|6666666.22288.peg.1995 | Periplasmic protein TonB, links inner and outer membranes |
| fig\|6666666.22288.peg.1997 | Biopolymer transport protein ExbD/TolR |
| fig\|6666666.22288.peg.1998 | Biopolymer transport protein ExbD/TolR |
| fig\|6666666.22288.peg.1999 | Biopolymer transport protein ExbD/TolR |
| fig\|6666666.22288.peg.2000 | Biopolymer transport protein ExbD/TolR |
| fig\|6666666.22288.peg.2003 | Cobalt-zinc-cadmium resistance protein CzcA; Cation efflux system protein CusA |
| fig\|6666666.22288.peg.2006 | Oligopeptide transport system permease protein OppB (TC 3.A.1.5.1) |
| fig\|6666666.22288.peg.2007 | Oligopeptide transport system permease protein OppC (TC 3.A.1.5.1) |
| fig\|6666666.22288.peg.2095 | Permease of the drug/metabolite transporter (DMT) superfamily |
| fig\|6666666.22288.peg.2109 | L-lysine permease |
| fig\|6666666.22288.peg.2117 | Permease of the drug/metabolite transporter (DMT) superfamily |

TABLE 10-continued

| Transmembrane Transporters | |
|---|---|
| ID | Protein |
| fig\|6666666.22288.peg.2126 | Biopolymer transport protein ExbD/TolR |
| fig\|6666666.22288.peg.2127 | Biopolymer transport protein ExbD/TolR |
| fig\|6666666.22288.peg.2132 | Oligopeptide transport system permease protein OppC (TC 3.A.1.5.1) |
| fig\|6666666.22288.peg.2158 | TonB-dependent receptor |
| fig\|6666666.22288.peg.2164 | Ferric enterobactin transport system permease protein FepG (TC 3.A.1.14.2) @ ABC-type Fe3+-siderophore transport system, permease 2 component |
| fig\|6666666.22288.peg.2165 | Ferric enterobactin transport system permease protein FepD (TC 3.A.1.14.2) @ ABC-type Fe3+-siderophore transport system, permease component |
| fig\|6666666.22288.peg.2166 | Enterobactin exporter EntS |
| fig\|6666666.22288.peg.2169 | RND efflux system, inner membrane transporter CmeB |
| fig\|6666666.22288.peg.2190 | Dipeptide transport system permease protein DppB (TC 3.A.1.5.2) |
| fig\|6666666.22288.peg.2191 | Oligopeptide transport system permease protein OppC (TC 3.A.1.5.1) |
| fig\|6666666.22288.peg.2200 | Sodium/alanine symporter family protein |
| fig\|6666666.22288.peg.2226 | ABC transport system, permease component YbhR |
| fig\|6666666.22288.peg.2227 | ABC transport system, permease component YbhS |
| fig\|6666666.22288.peg.2262 | Lipid A export ATP-binding/permease protein MsbA |
| fig\|6666666.22288.peg.2295 | Malate Na(+) symporter |
| fig\|6666666.22288.peg.2312 | Putative TEGT family carrier/transport protein |
| fig\|6666666.22288.peg.2331 | Cobalt-zinc-cadmium resistance protein CzcA; Cation efflux system protein CusA |
| fig\|6666666.22288.peg.2332 | Cobalt-zinc-cadmium resistance protein CzcA; Cation efflux system protein CusA |
| fig\|6666666.22288.peg.2333 | Probable RND efflux membrane fusion protein |
| fig\|6666666.22288.peg.2335 | Lysine-specific permease |
| fig\|6666666.22288.peg.2427 | Potassium efflux system KefA protein/Small-conductance mechanosensitive channel |
| fig\|6666666.22288.peg.2452 | Predicted nucleoside ABC transporter, permease 1 component |
| fig\|6666666.22288.peg.2453 | Predicted nucleoside ABC transporter, permease 2 component |
| fig\|6666666.22288.peg.2483 | Probable sodium-dependent transporter |
| fig\|6666666.22288.peg.2582 | Cytosine/purine/uracil/thiamine/allantoin permease family protein |
| fig\|6666666.22288.peg.2586 | Methionine ABC transporter permease protein |
| fig\|6666666.22288.peg.2645 | ABC-type sugar transport system, periplasmic component |
| fig\|6666666.22288.peg.2673 | TRANSPORTER, LysE family |
| fig\|6666666.22288.peg.2719 | Nucleoside permease NupC |
| fig\|6666666.22288.peg.2720 | probable transporter |
| fig\|6666666.22288.peg.2741 | FIG021862: membrane protein, exporter |
| fig\|6666666.22288.peg.2772 | Oligopeptide transport system permease protein OppC (TC 3.A.1.5.1) |
| fig\|6666666.22288.peg.2793 | calcium/proton antiporter |
| fig\|6666666.22288.peg.2846 | Nucleoside:H+ symporter:Major facilitator superfamily |
| fig\|6666666.22288.peg.2865 | Permeases of the major facilitator superfamily |
| fig\|6666666.22288.peg.2896 | Taurine transport system permease protein TauC |
| fig\|6666666.22288.peg.2932 | Chitobiose ABC transport system, permease protein 1 |
| fig\|6666666.22288.peg.2933 | N-Acetyl-D-glucosamine ABC transport system, permease protein 2 |
| fig\|6666666.22288.peg.2934 | L-Proline/Glycine betaine transporter ProP |
| fig\|6666666.22288.peg.2936 | probable Na/H+ antiporter |
| fig\|6666666.22288.peg.2945 | Cystine ABC transporter, permease protein |
| fig\|6666666.22288.peg.2975 | Probable glucarate transporter |
| fig\|6666666.22288.peg.3057 | Ribose ABC transport system, permease protein RbsC (TC 3.A.1.2.1) |
| fig\|6666666.22288.peg.3061 | Mg(2+) transport ATPase protein C |
| fig\|6666666.22288.peg.3065 | L-lactate permease |
| fig\|6666666.22288.peg.3101 | Zinc ABC transporter, periplasmic-binding protein ZnuA |
| fig\|6666666.22288.peg.3102 | Zinc ABC transporter, inner membrane permease protein ZnuB |
| fig\|6666666.22288.peg.3124 | Histidine ABC transporter, permease protein HisQ (TC 3.A.1.3.1) |
| fig\|6666666.22288.peg.3125 | Histidine ABC transporter, permease protein HisM (TC 3.A.1.3.1) |
| fig\|6666666.22288.peg.3144 | Mg(2+) transport ATPase, P-type (EC 3.6.3.2) |
| fig\|6666666.22288.peg.3190 | Sodium/bile acid symporter family |
| fig\|6666666.22288.peg.3200 | Thiamin ABC transporter, transmembrane component |
| fig\|6666666.22288.peg.3220 | Long-chain fatty acid transport protein |
| fig\|6666666.22288.peg.3275 | L-lysine permease |
| fig\|6666666.22288.peg.3277 | L-lysine permease |
| fig\|6666666.22288.peg.3286 | Homolog of fucose/glucose/galactose permeases |
| fig\|6666666.22288.peg.3333 | Amino acid transporters |
| fig\|6666666.22288.peg.3374 | Permease of the drug/metabolite transporter (DMT) superfamily |
| fig\|6666666.22288.peg.3382 | Biopolymer transport protein ExbD/TolR |
| fig\|6666666.22288.peg.3451 | Permeases of the major facilitator superfamily |
| fig\|6666666.22288.peg.3517 | major facilitator family transporter |
| fig\|6666666.22288.peg.3531 | Mg(2+) transport ATPase protein C |
| fig\|6666666.22288.peg.3532 | Manganese transport protein MntH |
| fig\|6666666.22288.peg.3534 | Permease of the drug/metabolite transporter (DMT) superfamily |
| fig\|6666666.22288.peg.3609 | Ferrous iron transport protein B |
| fig\|6666666.22288.peg.3673 | Uracil permease |
| fig\|6666666.22288.peg.3700 | probable sodium/alanine symporter |
| fig\|6666666.22288.peg.3704 | Glycerol-3-phosphate ABC transporter, permease protein UgpE (TC 3.A.1.1.3) |
| fig\|6666666.22288.peg.3705 | Glycerol-3-phosphate ABC transporter, permease protein UgpA (TC 3.A.1.1.3) |
| fig\|6666666.22288.peg.3777 | Molybdenum transport system permease protein ModB (TC 3.A.1.8.1) |
| fig\|6666666.22288.peg.3784 | ABC transporter, permease protein, putative |
| fig\|6666666.22288.peg.3787 | major facilitator superfamily MFS_1 |
| fig\|6666666.22288.peg.3790 | Transporter |
| fig\|6666666.22288.peg.3831 | Arginine/ornithine antiporter ArcD |

TABLE 10-continued

| Transmembrane Transporters | |
|---|---|
| ID | Protein |
| fig\|6666666.22288.peg.3887 | Cobalt-zinc-cadmium resistance protein CzcA; Cation efflux system protein CusA |
| fig\|6666666.22288.peg.3888 | Probable Co/Zn/Cd efflux system membrane fusion protein |
| fig\|6666666.22288.peg.3936 | Hemin ABC transporter, permease protein |
| fig\|6666666.22288.peg.3963 | RND efflux transporter |
| fig\|6666666.22288.peg.4003 | Ammonium transporter |
| fig\|6666666.22288.peg.4049 | Amino acid ABC transporter, permease protein |
| fig\|6666666.22288.peg.4068 | ABC transporter, ATP-binding/permease protein |
| fig\|6666666.22288.peg.4136 | Spermidine Putrescine ABC transporter permease component PotB (TC 3.A.1.11.1) |
| fig\|6666666.22288.peg.4137 | Spermidine Putrescine ABC transporter permease component potC (TC_3.A.1.11.1) |
| fig\|6666666.22288.peg.4180 | POTASSIUM/PROTON ANTIPORTER ROSB |
| fig\|6666666.22288.peg.4193 | MFS permease |
| fig\|6666666.22288.peg.4233 | Osmoprotectant ABC transporter inner membrane protein YehW |
| fig\|6666666.22288.peg.4235 | Putative ABC transport integral membrane subunit |
| fig\|6666666.22288.peg.4236 | probable ABC transporter |
| fig\|6666666.22288.peg.4258 | Sodium-dependent transporter |
| fig\|6666666.22288.peg.4300 | Oligopeptide transport system permease protein OppB (TC 3.A.1.5.1) |
| fig\|6666666.22288.peg.4301 | Oligopeptide transport system permease protein OppC (TC 3.A.1.5.1) |
| fig\|6666666.22288.peg.4326 | Glycine betaine transporter OpuD |
| fig\|6666666.22288.peg.4337 | major facilitator superfamily MFS_1 |
| fig\|6666666.22288.peg.4345 | ABC-type anion transport system, duplicated permease component |
| fig\|6666666.22288.peg.4373 | probable TonB protein |
| fig\|6666666.22288.peg.4380 | Potassium-transporting ATPase A chain (EC 3.6.3.12) (TC 3.A.3.7.1) |
| fig\|6666666.22288.peg.751 | Kup system potassium uptake protein |
| fig\|6666666.22288.peg.755 | Putative preQ0 transporter |
| fig\|6666666.22288.peg.992 | TonB-dependent receptor |
| fig\|6666666.22288.peg.1269 | Lead, cadmium, zinc and mercury transporting ATPase (EC 3.6.3.3) (EC 3.6.3.5); Copper-translocating P-type ATPase (EC 3.6.3.4) |
| fig\|6666666.22288.peg.2902 | Putative preQ0 transporter |
| fig\|6666666.22288.peg.3020 | Sodium-dependent phosphate transporter |

Table 11 provides examples of *C. subtsugae* ORFs encoding transmembrane proteases.

TABLE 11

| Transmembrane Proteases | |
|---|---|
| fig\|6666666.22288.peg.436 | Peptidase M50 |
| fig\|6666666.22288.peg.1909 | Membrane carboxypeptidase (penicillin-binding protein) |
| fig\|6666666.22288.peg.2281 | cell wall endopeptidase, family M23/M37 |
| fig\|6666666.22288.peg.2516 | probable Peptidase |
| fig\|6666666.22288.peg.2670 | Microbial collagenase, secreted (EC 3.4.24.3) |
| fig\|6666666.22288.peg.4364 | Peptidase M48, Ste24p precursor |
| fig\|6666666.22288.peg.2081 | Signal peptidase I (EC 3.4.21.89) |

Table 12 provides examples of *C. subtsugae* ORFs encoding transmembrane toxins.

TABLE 12

| Transmembrane Toxins | |
|---|---|
| fig\|6666666.22288.peg.308 | probable colicin V secretion atp-binding protein |
| fig\|6666666.22288.peg.101 | Hemolysins and related proteins containing CBS domains |
| fig\|6666666.22288.peg.670 | 21 kDa hemolysin precursor |
| fig\|6666666.22288.peg.1187 | Holin-like protein CidA |
| fig\|6666666.22288.peg.1949 | Hemolysin |
| fig\|6666666.22288.peg.2123 | probable porin protein |
| fig\|6666666.22288.peg.2602 | Zonula occludens toxin-like |
| fig\|6666666.22288.peg.2638 | Colicin V production protein |
| fig\|6666666.22288.peg.2639 | DedD protein |
| fig\|6666666.22288.peg.2877 | hemolysin secretion protein D |
| fig\|6666666.22288.peg.2878 | cyclolysin secretion ATP-binding protein |
| fig\|6666666.22288.peg.3656 | Antiholin-like protein LrgA |
| fig\|6666666.22288.peg.3881 | porin signal peptide protein |
| fig\|6666666.22288.peg.307 | HlyD family secretion protein |

Table 13 provides examples of *C. subtsugae* ORFs encoding antibiotics and proteins involved in antibiotic resistance.

TABLE 13

| | |
|---|---|
| fig\|6666666.22288.peg.30 | Beta-lactamase (EC 3.5.2.6) |
| fig\|6666666.22288.peg.48 | rarD protein, chloamphenicol sensitive |
| fig\|6666666.22288.peg.540 | Fosmidomycin resistance protein |
| fig\|6666666.22288.peg.584 | Polymyxin resistance protein ArnT, undecaprenyl phosphate-alpha-L-Ara4N transferase; Melittin resistance protein PqaB |
| fig\|6666666.22288.peg.587 | Polymyxin resistance protein ArnC, glycosyl transferase (EC 2.4.—.—) |
| fig\|6666666.22288.peg.1176 | Polymyxin resistance protein ArnT, undecaprenyl phosphate-alpha-L-Ara4N transferase; Melittin resistance protein PqaB |
| fig\|6666666.22288.peg.1177 | Polymyxin resistance protein ArnC, glycosyl transferase (EC 2.4.—.—) |
| fig\|6666666.22288.peg.1509 | Multiple antibiotic resistance protein marC |
| fig\|6666666.22288.peg.1736 | Hydrogen cyanide synthase HcnC/Opine oxidase subunit B |
| fig\|6666666.22288.peg.3072 | Arsenical-resistance protein ACR3 |
| fig\|6666666.22288.peg.3756 | Multiple antibiotic resistance protein marC |
| fig\|6666666.22288.peg.4348 | Undecaprenyl-phosphate N-acetylglucosaminyl 1-phosphate transferase (EC 2.7.8.—) |

Homologues The present disclosure also provides methods of obtaining homologues of the fragments of the *C. subtsugae* genome disclosed herein, and homologues of the proteins encoded by the ORFs disclosed herein. Specifically, by using the nucleotide and amino acid sequences disclosed herein as a probe or as primers, and techniques such as PCR cloning and colony/plaque hybridization, one skilled in the art can obtain said homologues. Such homologues can be obtained from any organism; e.g., other species of *Chromobacterium* or other bacteria.

Antibodies, Detection Methods, Kits Also provided are antibodies which selectively bind a protein or polypeptide fragment encoded by the *C. subtsugae* genome. Such antibodies, in addition, can comprise a detectable label and/or be attached to a solid support. Such antibodies include both monoclonal and polyclonal antibodies. Also provided are hybridomas which produce the above-described monoclonal antibodies.

In additional embodiments, the present disclosure provides methods of identifying test samples derived from cells that express one or more of the ORFs disclosed herein, or homologues thereof. Such methods comprise incubating a test sample with one or more of the antibodies of the present disclosure, or one or more fragments of the *C. subtsugae* genome, under conditions which allow a skilled artisan to determine if the sample contains the ORF (or portion thereof) or product produced therefrom.

In additional embodiments, kits are provided which contain the necessary reagents to carry out the above-described assays. Specifically, provided herein is a compartmentalized kit designed to receive, in close confinement, one or more containers which comprises: (a) a first container comprising one of the antibodies, or one of the *C. subtsugae* genome fragments of the present disclosure; and (b) one or more other containers comprising one or more of the following: wash reagents, reagents capable of detecting presence of bound antibodies or reagents capable of detecting presence of hybridized nucleic acids.

Using the isolated proteins disclosed herein, the present disclosure further provides methods of obtaining and identifying agents capable of binding to a protein encoded by a *C. subtsugae* ORF. Specifically, such agents include antibodies (described above), peptides, carbohydrates, pharmaceutical agents and the like. Such methods comprise the steps of: (a) contacting an agent with an isolated protein encoded by one of the ORFs disclosed herein; and (b) determining whether the agent binds to said protein. Methods for detecting protein-protein binding are well-known in the art and include, for example, filter-binding, immunoprecipitation, two-hybrid assays, gel retardation and reporter subunit complementation. See, for example, U.S. Pat. Nos. 5,503,977 and 5,585,245; Fields et al. (1989) *Nature* 340: 245-247; Bai et al. (1996) *Meth. Enzymol.* 273:331-347 and Luo et al. (1997) *BioTechniques* 22:350-352.

Vectors For embodiments in which a polypeptide is produced using recombinant techniques, the methods can involve any suitable construct and any suitable host cell, which can be a prokaryotic or eukaryotic cell (e.g. a bacterial host cell, a yeast host cell, a plant host cell, an insect host cell, or a cultured mammalian host cell). Methods for introducing genetic material into host cells are well-known in the art and include, for example, biolistics, transformation, electroporation, lipofection, conjugation, calcium phosphate co-precipitation and the like. The method for transfer can be selected so as to provide for stable expression of the introduced polypeptide-encoding nucleic acid. The polypeptide-encoding nucleic acid can be provided as an inheritable episomal element (e.g., plasmid) or can be genomically integrated.

Viral vectors can also be used for cloning and expression of the nucleic acids disclosed herein. Exemplary plant viral vectors include cauliflower mosaic virus (CaMV), pea early browning virus (PEBV), bean pod mottle virus (BPMV), cucumber mosaic virus (CMV), apple latent spherical virus (ALSV), tobacco mosaic virus (TMV), potato virus X, brome mosaic virus (BMV) and barley stripe mosaic virus (BSMV).

Additional vectors can be used for expression of *C. subtsugae* polypeptide sequences in non-plant organisms. These include prokaryotic cloning vectors (e.g., pBR322, pUC, bacteriophage lambda), fungal vectors (e.g., yeast 2-micron plasmid), insect cloning vectors (e.g., baculovirus) and mammalian vectors (e.g., SV40).

Suitable vectors for transferring a polypeptide-encoding nucleic acid can vary in composition. Integrative vectors can be conditionally replicative or suicide plasmids, bacteriophages, and the like. The constructs can include various elements, including for example, promoters, selectable genetic markers (e.g., genes conferring resistance to antibiotics, for example, instance neomycin, G418, methotrexate, ampicillin kanamycin, erythromycin, chloramphenicol, or gentamycin), origins of replication (to promote replication in a host cell, e.g., a bacterial host cell), and the like. The choice of vector depends upon a variety of factors such as the type of cell in which propagation is desired and the purpose of propagation. Certain vectors are useful for amplifying and making large amounts of the desired DNA sequence. Other vectors are suitable for expression of protein in cells. Still other vectors are suitable for transfer and expression in cells in a whole animal or plant. The choice of appropriate vector is well within the skill of the art. Many such vectors are available commercially.

The vector used can be an expression vector based on episomal plasmids containing selectable drug resistance markers and elements that provide for autonomous replication in different host cells. Vectors are amply described in numerous publications well known to those in the art, including, e.g., Short Protocols in Molecular Biology, (1999) F. Ausubel, et al., eds., Wiley & Sons. Vectors may provide for expression of the nucleic acids encoding the subject polypeptide, may provide for propagating the subject nucleic acids, or both.

Constructs can be prepared by, for example, inserting a polynucleotide of interest into a construct backbone, typically by means of DNA ligase attachment to a cleaved restriction enzyme site in the vector. Alternatively, the desired nucleotide sequence can be inserted by homologous recombination or site-specific recombination, or by one or more amplification methods (e.g., PCR). Typically homologous recombination is accomplished by attaching regions of homology to the vector on the flanks of the desired nucleotide sequence, while site-specific recombination can be accomplished through use of sequences that facilitate site-specific recombination (e.g., cre-lox, att sites, etc.). Nucleic acid containing such sequences can be added by, for example, ligation of oligonucleotides, or by polymerase chain reaction using primers comprising both the region of homology and a portion of the desired nucleotide sequence.

For expression of the polypeptide of interest, an expression cassette can be employed. Thus, the present disclosure provides a recombinant expression vector comprising a subject nucleic acid. The expression vector can provide transcriptional and translational regulatory sequences, and can also provide for inducible or constitutive expression, wherein the coding region is operably placed under the transcriptional control of a transcriptional initiation region (e.g., a promoter, enhancer), and transcriptional and translational termination regions. These control regions may be native to the *C. subtsugae* genome, or can be derived from exogenous sources. As such, control regions from exogenous sources can be considered heterologous elements that are operably linked to the nucleic acid encoding the subject polypeptide. In general, the transcriptional and translational regulatory sequences can include, but are not limited to, promoter sequences, operator sequences, ribosomal binding sites, transcriptional start and stop sequences, translational start and stop sequences, polyadenylation sites and enhancer or activator sequences. Promoters can be either constitutive or inducible, and can be a strong constitutive promoter (e.g., T7 promoter, SP6 promoter, and the like).

Exemplary plant regulatory sequences, which can be used in the recombinant constructs disclosed herein, include constitutive promoters such as the CaMV 19S and 35S promoters and those from genes encoding actin or ubiquitin. Alternatively, regulated promoters such as chemically-regulated promoters (e.g., tetracycline-regulated) and wound-inducible promoters (expressed at wound sites and at sites of phytopathogenic infection) can also be used. In additional embodiments, promoters can be tissue-specific (e.g., specifying expression in roots, leaves, flowers, inflorescences) and/or temporally regulated (e.g., specifying expression in seedlings).

Additional promoters for use in plant cells have been described. See, for example, Stanford et al. (1989) *Mol. Gen. Genet.* 215: 200-208; Xu et al. (1993) *Plant Molec. Biol.* 22: 573-588; Logemann et al. (1989) *Plant Cell* 1: 151-158; Rohrmeier & Lehle (1993) *Plant Molec. Biol.* 22: 783-792; Firek et al. (1993) *Plant Molec. Biol.* 22: 129-142 and Warner et al. (1993) *Plant J.* 3: 191-201.

Consensus plant translation initiation sequences (i.e., ribosome-binding sites) have been described by Joshi (1987) *Nucleic Acids Res.* 15:6643-6653 and in the Clontech Catalogue 1993/1994, page 210.

Expression vectors generally have convenient restriction sites located near the promoter sequence to provide for the insertion of nucleic acid sequences encoding proteins of interest. A selectable marker operative in the expression host can be present to facilitate selection of cells containing the vector. In addition, the expression construct can include additional elements. For example, the expression vector can have one or two replication systems, thus allowing it to be maintained, for example, in plant or insect cells for expression and in a prokaryotic host for cloning and amplification. In addition, the expression construct can contain a selectable marker gene to allow the selection of transformed host cells. Selection genes are well-known in the art and vary depending on the host cell used.

Expression vectors provided herein contain the aforementioned nucleic acids and/or polynucleotides. Such expression vectors can contain promoters (e.g., T7 promoter, T3 promoter, SP6 promoter, *E. coli* RNA polymerase promoter, lac promoter and its derivatives, tac promoter, trp promoter, the arabinose-inducible $P_{BA\ D}$ promoter, the L-rhamnose-inducible rha$P_{BAD}$ promoter, bacteriophage lambda promoters (e.g., $P_L$), CMV promoter, SV40 promoter, PGK promoter, EF-1alpha promoter), operators, transcription termination signals (e.g., SV40 termination signal), splice sites (e.g., SV40 splice sites, beta-globin splice site), ribosome binding sites, signal sequences (e.g., immunoglobulin kappa signal sequence), epitopes tags (e.g., myc, FLAG), purification tags (e.g., $His_6$), replication origins and drug selection markers. Linker sequences, encoding linker amino acids and/or comprising restriction enzyme recognition sites, or any other type of linker sequence, can also be operably linked to the nucleic acid encoding the subject polypeptide present in the vectors disclosed herein.

Cosmid libraries can be prepared by methods known in the art. See, for example, Maniatis et al. Molecular Cloning: A Laboratory Manual. Cold Spring Harbor Press, 2$^{nd}$ edition, 1989 and Sambrook et al., 2001. Such a library can be used for sequence-based screening and for any type functional screening of cells, or of supernatants, whole cell broths, cell-free lysates, or extracts derived from the cells. High throughput biological assays for herbicidal screening, enzymatic activities, anti-cancer activity, etc. are known in the art and described in the literature. See also Examples 7-11 herein.

Host cells The present disclosure further contemplates recombinant host cells containing an exogenous polynucleotide. Said polynucleotide can comprise one or more fragments of the *C. subtsugae* genome as disclosed herein, or can encode one or more of the polypeptides of the present disclosure. Host cells can be procaryotic (e.g., bacterial) or eucaryotic (e.g., yeast, insect, mammalian). The host can also be a synthetic cell.

In certain embodiments, the host cell is a microorganism. Suitable microorganisms are those capable of colonizing plant tissue (e.g. root, stems, leaves, flowers, internally and on the surface), or the rhizosphere, in such manner that they come in contact with insect pests. Some of the host microorganisms can also be capable of colonizing the gut of an insect pest, and be capable of being transmitted from one insect to another. Host microorganisms can also colonize the gut and body surface of a plant pest. The host cell can also be used as a microbial factory for the production of *C. subtsugae* proteins, or for production of one or more compounds produced by the activity of *C. subtsugae* proteins such as, for example, peptides, lipids, lipopeptides, glycoproteins, secondary metabolites, antibiotics and small organic compounds.

Gram-negative microorganisms suitable for heterologous expression include: *Escherichia coli* (e.g., *E. coli* K12, *E. coli* BL21), *Pseudomonas* sp. (e.g. *Pseudomonas fluorescens, Pseudomonas putida, Psuedomonas aurantiaca, Psuedomonas aureofaciens, Psuedomonas protegens*), *Enterobacter* sp. (e.g. *Enterobacter cloacae*), and *Serratia* sp. Exemplary *E. coli* strains include *E. coli* BL21 and *E. coli* K12 for routine expression. Other *E. coli* strains, for more specialized purposes, are those which display protease deficiency (BL21-B838) and those which overexpress membrane proteins such as the BL21 derivative DE3, C41 (DE3) and C43 (DE3).

Methods for high-level expression of heterologous proteins in *E. coli* are known and include (a) IPTG-induction methods, (b) auto-induction methods, and (c) high cell-density IPTG-induction methods. See, for example, Sivashanmugam et al. (2009).

Gram-positive microorganisms suitable for heterologous expression include *Bacillus* sp. (e.g., *Bacillus megaterium, Bacillus subtilis, Bacillus cereus*), and *Streptomyces* sp. One advantage of using *Bacillus* as an expression host is that members of this genus produce spores, which provide formulations with better stability and longer shelf life. Expression systems based on *Bacillus megaterium* and *Bacillus subtilis* are commercially available from MoBiTec (Germany). Nucleotide sequences of interest can be expressed in *Bacillus megaterium* using under the control of the promoter of the xylose operon.

Fungal microorganisms suitable for heterologous expression include *Trichoderma* sp., *Gliocadium, Saccharomyces cerevisiae,* and *Pichia pastoris.* Heterologous DNA can be introduced into filamentous fungi by protoplast-mediated transformation using polyethylene glycol (PEG) or by electroporation-based methods. Particle bombardment is another method that has been successfully used to transform fungal cells.

Methods and compositions for transformation of *Saccharomyces cerevisiae* are well-known in the art. For example, a nucleic acid can be cloned into a suitable vector (e.g., the YES vectors (Invitrogen, Carlsbad, Calif.), under the control of an inducible promoter such as GAL1, and the CYC1 terminator, and expressed in *Saccharomyces cerevisiae*. The resulting cells can be tested for the desired activity, or for protein expression.

Heterologous expression can also be conducted in other yeast species (Jeffries et al., 2010), such as *Pichia pastoris, Hansenula polymorpha, Arxula adenivorans* and *Yarrowia lipolytica*. Transformation of *Pichia pastoris* can be achieved with the use of a commercial kit, such as the PichiaPink Expression System (Invitrogen, Carlsbad, Calif.), the *Pichia* Classic Protein Expression System or the *Pichia* GlycoSwitch (for glycosylated proteins) (Research Corporation Technologies, Tucson, Ariz.). For transformation of the yeasts *Pichia pastoris* or *Hansenula. polymorpha,* electroporation can also be used.

In certain embodiments, non-pathogenic symbiotic bacteria, which are able to live and replicate within plant tissues (i.e., endophytes), or non-pathogenic symbiotic bacteria, which are capable of colonizing the phyllosphere or the rhizosphere (i.e., epiphytes) are used. Such bacteria include bacteria of the genera *Agrobacterium, Alcaligenes, Azospirillum, Azotobacter, Bacillus, Clavibacter, Enterobacter, Erwinia, Flavobacter, Klebsiella, Pseudomonas, Rhizobium, Serratia, Streptomyces* and *Xanthomonas.*

Symbiotic fungi, such as *Trichoderma* and *Gliocladium* can also be used as hosts for propagation and/or expression of the sequences disclosed herein.

Formulations and Pesticidal Compositions The present disclosure provides pesticidal (e.g., insecticidal) compositions and formulations comprising the nucleic acids and polypeptides disclosed herein.

A "pest" is an organism (procaryotic, eucaryotic or Archael) that increases mortality and/or slows, stunts or otherwise alters the growth of a plant. Pests include, but are not limited to, nematodes, insects, fungi, bacteria, and viruses.

A "pesticide" as defined herein, is a substance derived from a biological product, or a chemical substance, that increases mortality and/or inhibits the growth rate of plant pests. Pesticides include but are not limited to nematocides, insecticides, herbicides, plant fungicides, plant bactericides, and plant viricides.

A "biological pesticide" as defined herein is a microorganism with pesticidal properties.

A "pesticidal composition" is a formulation comprising a pesticide and optionally one or more additional components. Additional components include, but are not limited to, solvents (e.g., amyl acetate, carbon tetrachloride, ethylene dichloride; kerosene, xylene, pine oil, and others listed in EPA list 4a and 4b etc.), carriers, (e.g., organic flour, Walnut shell flour, wood bark), pulverized mineral (sulfur, diatomite, tripolite, lime, gypsum talc, pyrophyllite), clay (attapulgite bentonites, kaolins, volcanic ash, and others listed in EPA list 4a and 4b), stabilizers, emulsifiers (e.g., alkaline soaps, organic amines, sulfates of long chain alcohols and materials such as alginates, carbohydrates, gums, lipids and proteins, and others listed in EPA list 4a and 4b), surfactants (e.g., those listed in EPA list 4a and 4b), anti-oxidants, sun screens, a second pesticide, either chemical or biological (e.g., insecticide, nematicide, miticide, algaecide, fungicide, bactericide), an herbicide an/or an antibiotic.

A "carrier" as defined herein is an inert, organic or inorganic material, with which the active ingredient is mixed or formulated to facilitate its application to plant or other object to be treated, or its storage, transport and/or handling.

Pesticidal compositions as disclosed herein are useful for modulating pest infestation in a plant. The term "modulate" as defined herein is used to mean to alter the amount of pest infestation or rate of spread of pest infestation. Generally, such alteration is a lowering of the degree and/or rate and/or spread of the infestation.

The term "pest infestation" as defined herein, is the presence of a pest in an amount that causes a harmful effect including a disease or infection in a host population or emergence of an undesired weed in a growth system. Exemplary plant pests include, but are not limited to, mites (e.g., *Tetranychus urticae* (Two-spotted spider mite)), fruit flies (e.g., *Drosophila suzukii, Drosophila melanogaster*), house flies (e.g., *Musca domestica*), arachnids (e.g., *Acari* spp.), root maggots (*Anthomyidae* spp., e.g. Cabbage Root Maggots), aphids (e.g., *Myzus persicae* (green peach aphid)), *Triozidae* spp. (e.g., potato psyllid (*Bactericera cockerelli*)), beetles (*Tenebrionidae* spp., e.g., litter beetles (*Alphitobius diaperinus*)), grubs (e.g., white grub (*Cyclocephala lurida*), Southern Masked Chafer (*Rhizotrogus majalis*), Japanese beetle (*Popillia japonica*) larvae, black vine weevil (*Otiorhyncus sulcatus*) larvae, Oriental beetle (*Anomala orientalis*) larvae, scarabs (e.g., *Scarabaeidae* spp.), nematodes (e.g., Root-knot nematode (*Meloidogyne* spp.)), fungi, bacteria, and various plant viruses, for example, Tobacco mosaic virus, Tomato spotted wilt virus, Tomato yellow leaf curl virus, Cucumber mosaic virus, Potato virus Y, Cauliflower mosaic virus, African cassava mosaic virus, Plum pox virus, Brome mosaic virus, Potato virus X, Citrus tristeza virus, Barley yellow dwarf virus, Potato leaf roll virus and Tomato bushy stunt virus.

Pesticidal compositions, as disclosed herein, can be used either for prophylactic or modulatory purposes. When provided prophylactically, the compositions(s) are provided in advance of any symptoms of infestation. The prophylactic administration of the composition(s) serves to prevent, attenuate, or decrease the rate of onset of any subsequent infection or infestation. When provided for modulatory purposes, the composition(s) are provided at (or shortly after) the onset of an indication of infection or infestation. Modulatory administration of the compound(s) serves to attenuate the pathological symptoms of the infection or infestation and to increase the rate of recovery.

Additional methods can be employed to control the duration of action. Controlled-release can be achieved through the use of polymers to complex or absorb one or more of the components of the composition. The controlled delivery may be exercised by selecting appropriate macromolecules (for example polyesters, polyamino acids, polyvinyl, pyrrolidone, ethylenevinylacetate, methylcellulose, carboxymethylcellulose, or protamine, sulfate) and the concentration of macromolecules as well as the methods of incorporation in order to control release. Another possible method to control the duration of action by controlled release preparations is to incorporate compositions as disclosed herein into particles of a polymeric material such as polyesters, polyamino acids, hydrogels, poly(lactic acid) or ethylene vinylacetate copolymers. Alternatively, instead of incorporating these compositions into polymeric particles, it is possible to entrap these materials in microcapsules prepared, for example, by coacervation techniques or by interfacial polymerization, for example, hydroxymethylcellulose or gelatine-microcapsules and poly(methylmethacylate) microcapsules, respectively, or in colloidal delivery systems, for example, liposomes, albumin microspheres, microemulsions, nanoparticles, and nanocapsules or in macroemulsions. Such techniques are known in the art.

Pesticidal compositions as disclosed herein, (e.g., pesticidal toxins) can be produced by expression of selected *Chromobacterium substugae* genome sequences in heterologous hosts suitable for lab scale, pilot scale and manufacturing scale fermentation (e.g., *E. coli, Psuedomonas* sp., yeast, etc.). Toxins can be produced by fermentation procedures known in the art using the heterologous host and formulated directly, or after extraction and purification of the toxin from the fermentation broth. The formulation can include live cells or non-viable cells.

The pesticidal compositions disclosed herein can be formulated in any manner. Non-limiting formulation examples include, but are not limited to, emulsifiable concentrates (EC), wettable powders (WP), soluble liquids (SL), aerosols, ultra-low volume concentrate solutions (ULV), soluble powders (SP), microencapsulates, water dispersed granules, flowables (FL), microemulsions (ME), nano-emulsions (NE), etc. In any of the formulations described herein, the percentage of the active ingredient is within a range of 0.01% to 99.99%. Detailed description of pesticide formulations can be found in the Kirk-Othmer Encyclopedia of Chemical Technology.; Knowles, A. 2005. New Developments in Crop Protection Product Formulation, Agrow Reports, London, UK; Valkenburg, W. van (ed.) 1973, Pesticide Formulation, Marcel Dekker, New York, USA; Knowles, D. A. (ed.) 1998, Chemistry and Technology of Agrochemical Formulations, Kluwer Academic Publishers, Dordrecht, the Netherlands.

Powder and Dust formulations These are simple formulations that usually contain 0.1-25% of the active ingredient. However, higher concentrations of active ingredient can be used depending on the potency and particular application. The pesticide toxin is mixed with a solid carrier, preferably of small particle size. Solid carriers can include: silicate clays (e.g., attapulgite, bentonites, volcanic ash, montmorillionite, kaolin, talc, diatomites, etc.), carbonates (e.g., calcite, dolomite, etc), synthetics (precipitated silica, fumed silica, etc.), ground botanicals (e.g., corn cob grits, rice hulls, coconut shells, etc.), organic flour (e.g., Walnut shell flour, wood bark, etc.) or pulverized mineral (e.g., Sulphur, diatomite, tripolite, lime, gypsum talc, pyrophyllite, etc.). The inert ingredients used in dust formulations can also come from those listed in EPA Inert List 4a (www.epa.gov/opprd001/inerts/inerts_list4Acas.pdf) for conventional formulations and 4b (www.epa.gov/opprd001/inerts/inerts_list4Bname.pdf) for organic formulations. Small particle size can be achieved by mixing the active ingredient with the carrier and pulverizing in a mill. Dusts are defined as having a particle size less than 100 microns; and with increase in particle size the toxicity of the formulation decreases. In the selection of a dust formulation its compatibility, fineness, bulk density, flow ability, abrasiveness, absorbability, specific gravity and cost should be taken into consideration. Exemplary dust formulations are provided in Table 14

TABLE 14

| Formulation components | Formulation A | Formulation B | Formulation C | Formulation D |
|---|---|---|---|---|
| Active ingredient | 0.65 | 5 | 10 | 25 |
| Talc | 50 | | 90 | |
| Kaolin or other clay | 49.35 | 95 | | 75 |

A dust formulation can also be prepared from a dust concentrate (e.g., 40% active ingredient, 5% stabilizer, 20% silica, 35% magnesium carbonate) added at 1-10% to a 1:1 organic filler/talc combination.

The dust formulation is used as a contact powder (CP) or tracking powder (TP) against crawling insects.

A dust formulation with high flowability can be applied by pneumatic equipments in greenhouses.

Granular and pellet formulations The pesticidal toxin is applied in liquid form to coarse particles of porous material (e.g., clay, walnut shells, vermiculite, diatomaceous earth, corn cobs, attapulgite, montmorillioinite, kaolin, talc, diatomites, calcite, dolomite, silicas, rice hulls, coconut shells, etc.). The granules or pellets can be water dispersible, and can be formed by extrusion (for pesticidal actives with low water solubility), agglomeration or spray drying. Granules can also be coated or impregnated with a solvent-based solution of the pesticidal toxin. The carrier particles can be selected from those listed in EPA Inert List 4a (www.epa-.gov/opprd001/inerts/inerts_list4Acas.pdf) for conventional formulations and 4b (www.epa.gov/opprd001/inerts/inerts_list4Bname.pdf) for organic formulations. The active ingredient can be absorbed by the carrier material or coated on the surface of the granule. Particle size can vary from 250 to 1250 microns (0.25 mm to 2.38 mm) in diameter. The formulations usually contain 2 to 10 percent concentration of the toxicant. The granules are applied in water or whorls of plant or to soil at the rate of 10 kg/ha. Granular formulations of systemic insecticides are used for the control of sucking and soil pest by application to soil. Whorl application is done for the control of borer pests of crops such as sorghum, maize and sugarcane, etc. These types of formulations reduce drift and allow for slower release of the pesticidal composition.

Granular pesticides are most often used to apply chemicals to the soil to control weeds, fire ants, nematodes, and insects living in the soil or for absorption into plants through the roots. Granular formulations are sometimes applied by airplane or helicopter to minimize drift or to penetrate dense vegetation. Once applied, granules release the active ingredient slowly. Some granules require soil moisture to release the active ingredient. Granular formulations also are used to control larval mosquitoes and other aquatic pests. Granules are used in agricultural, structural, ornamental, turf, aquatic, right-of-way, and public health (biting insect) pest control operations.

Application of granular formulations is common in pre-emergence herbicides or as soil insecticides for direct application and incorporation into soil or other solid substrates where plants grow. Granules or pellets can also be applied in-furrow. Granules are commonly used for application to water, such as in flooded rice paddies.

A typical granule formulation includes (%w/w) 1-40% active ingredient, 1-2% stabilizer, 0-10% resin or polymer, 0-5% surfactant, 0-5% binder and is made up to 100% with the carrier material.

Wettable Powder Formulations

Wettable powder is a powdered formulation which yields a rather stable suspension when diluted with water. It is formulated by blending the pesticidal agent with diluents such as attapulgite, a surface active agent and auxiliary materials such as sodium salts of sulfo acids. Optionally stickers are added to improve retention on plants and other surfaces. Wettable powders can be prepared by mixing the pesticidal toxin (10-95%) with a solid carrier, plus 1-2% of a surface-active agent to improve suspensibility. The overall composition of the formulation includes the active ingredient in solid form (5.0-75%), an anionic dispersant and an anionic or nonionic wetting agent.

A typical example of a wettable powder formulation includes 10-80% active ingredient, 1-2% wetting agents (e.g., benzene sulphonates, naphthalene sulphonates, aliphatic suplhosuccinates, aliphatic alcohol etoxylates, etc.), 2-5% dispersing agent (e.g., lignosulphonates, naphthalene sulphonate-formaldehyde condensates, etc.), and 0.1-1% antifoaming agent (e.g., isopar M (Exxon/Mobil)), made up to 100% with an inert filler or carrier (e.g., diatomaceous earth, silica, etc.).

Emulsifiable concentrate (EC) formulations These are concentrated pesticide formulation containing an organic solvent and a surfice-active agent to facilitate emulsification with water. When EC formulations are sprayed on plant parts, the solvent evaporates quickly, leaving a deposit of toxin from which water also evaporates. Exemplary emulsifying agents in insecticide formulations include alkaline soaps, organic amines, sulfates of long chain alcohols and materials such as alginates, carbohydrates, gums, lipids and proteins. Emulsifying agents can be selected from those listed in EPA Inert List 4a (www.epa.gov/opprd001/inerts/inerts_list4Acas.pdf) for conventional formulations and 4b (www.epa.gov/opprd001/inerts/inerts_list4Bname.pdf) for organic formulations.

Solution formulations A solution formulation is a concentrated liquid pesticide formulation that can be used directly, or require dilution in the case of a soluble concentrate. Soluble concentrates and solutions are water- or solvent-based mixtures with complete miscibility in water.

A typical example of a solution concentrate formulation includes 20-70% active ingredient, 5-15% wetting agent, 5-10% antifreeze, and is made up to 100% with water or a water miscible solvent.

Depending on the nature and stability of the pesticidal toxin, a solution formulation can optionally include thickeners, preservatives, antifoam, pH buffers, UV screens, etc.

Aerosol and fumigant formulations In an insecticidal aerosol, the toxin is suspended as minute particles having sizes ranging from 0.1 to 50 microns in air as a fog or mist. This is achieved by burning the toxin or vaporizing it by heating. The toxicant dissolved in a liquefied gas, if released through small hole, may cause the toxicant particles to float in air with the rapid evaporation of the released gas.

A chemical compound, which is volatile at ambient temperatures and sufficiently toxic, is known as a fumigant. Fumigants generally enter an insect via its tracheal system. Fumigants are used for the control of insect pests in storage bins, buildings and certain insects and nematodes in the soil. Most fumigants are liquids held in cans or tanks and often comprise mixtures of two or more gases. Alternatively, phosphine or hydrogen phosphide gas can be generated in the presence of moisture from a tablet made up of aluminium phosphide and ammonium carbonate. The advantage of using a fumigant is that sites that are not easily accessible to other chemicals can be reached with fumigants, due to the penetration and dispersal of the gas. Commonly used fumigants are EDCT, methyl bromide, aluminium phosphide and hydrocynic acid.

Formulation in Fertilizers Mixtures A fertilizer mixture can be manufactured by addition of an insecticidal composition, as disclosed herein, to a chemical fertilizer, or by spreading the composition directly on the fertilizer. Fertilizer mixtures are applied at the regular fertilizing time and provide both plant nutrients and control of soil insects. In an exemplary fertilizer formulation, urea (2% solution) is mixed with an insecticidal composition and sprayed for supply of nitrogen to the plant and for realizing effective pest control.

Formulation as Poison Baits. Poison baits consist of a base or carrier material attractive to the pest species and a chemical toxicant in relatively small quantities. The poison baits are used for the control of fruit flies, chewing insects, wireworms, white grubs in the soil, household pests, rats in the field and slugs. These formulations are useful for situations in which spray application is difficult. A common base used in dry baits is wheat bran moistened with water and molasses. For the control of fruit sucking moths fermenting sugar solution or molasses with a toxin is used.

Formulations for seed treatments Seed treatments include application of a pesticidal composition, optionally in combination with other bioactive, antagonistic or symbiotic agents, to the surface of a seed prior to sowing. The pesticidal toxins, proteins, and/or compounds disclosed herein can be formulated for seed treatments in any of the following modes: dry powder, water slurriable powder, liquid solution, flowable concentrate or emulsion, emulsion, microcapsules, gel, or water dispersible granules; or can be applied to seeds by spraying on the seed before planting.

In the case of a dry powder, the active ingredient is formulated similarly to a wettable powder, but with the addition of a sticking agent, such as mineral oil, instead of a wetting agent. For example: one kg of purified talc powder (sterilized for 12 h), 15 g calcium carbonate, and 10 g carboxymethyl cellulose are mixed under aseptic conditions following the method described by Nandakumar et al (2001). Protein, nucleic acid suspensions or organisms expressing these are mixed in a 1:2.5 ratio (suspension to dry mix) and the product is shade dried to reduce moisture content to 20-35%.

The compositions can be in the form of a liquid, gel or solid.

A solid composition can be prepared by suspending a solid carrier in a solution of active ingredient(s) and drying the suspension under mild conditions, such as evaporation at room temperature or vacuum evaporation at 65° C. or lower. For liquid compositions, the active ingredient can be dissolved in a suitable carrier or solvent.

A composition can comprise gel-encapsulated active ingredient(s). Such gel-encapsulated materials can be prepared by mixing a gel-forming agent (e.g., gelatin, cellulose, or lignin) with a composition comprising one or more nucleic acids and/or polypeptides as disclosed herein, and optionally a second pesticide or herbicide; and inducing gel formation of the agent.

The composition can additionally comprise a surfactant to be used for the purpose of emulsification, dispersion, wetting, spreading, integration, disintegration control, stabilization of active ingredients, and improvement of fluidity or rust inhibition. In a particular embodiment, the surfactant is a non-phytotoxic non-ionic surfactant which preferably belongs to EPA List 4B. In another particular embodiment, the nonionic surfactant is polyoxyethylene (20) monolaurate. The concentration of surfactants can range between 0.1-35% of the total formulation, e.g., from 5-25%. The choice of dispersing and emulsifying agents, such as nonionic, anionic, amphoteric and cationic dispersing and emulsifying agents, and the amount employed, is determined by the nature of the composition and the ability of the agent to facilitate the dispersion of the composition.

Formulations comprising microorganisms Pesticidal compositions as set forth above can be combined with a microorganism. The microorganism can be a plant growth promoter. Suitable microorganisms include, but are not limited to, *Bacillus* sp. (e.g., *Bacillus firmus, Bacillus thuringiensis, Bacillus pumilus, Bacillus licheniformis, Bacillus amyloliq-*

*uefaciens, Bacillus subtilis*), *Paecilomyces* sp. (*P. lilacinus*), *Pasteuria* sp. (*P. penetrans*), *Pseudomonas* sp., *Brevabacillus* sp., *Lecanicillium* sp., *Ampelomyces* sp., *Pseudozyma* sp., *Streptomyces* sp (*S. bikiniensis, S. costaricanus, S. avermitilis*), *Burkholderia* sp., *Trichoderma* sp., *Gliocladium* sp., avermectin, *Myrothecium* sp., *Paecilomyces* spp., *Sphingobacterium* sp., *Arthrobotrys* sp., *Chlorosplenium* sp., *Neobulgaria* sp., *Daldinia* sp., *Aspergillus* sp., *Chaetomium* sp., *Lysobacter* sp., *Lachnum papyraceum, Verticillium suchlasporium, Arthrobotrys oligospora, Verticillium chlamydosporium, Hirsutella rhossiliensis, Pochonia chlamydosporia, Pleurotus ostreatus, Omphalotus olearius, Lampteromyces japonicas, Brevudimonas* sp., *Muscodor* sp., *Photorhabdus* sp., *and Burkholderia* sp. Agents obtained or derived from such microorganisms can also be used in combination with the pesticidal nucleic acids and polypeptides disclosed herein.

Formulations comprising second pesticides Pesticidal compositions as set forth above can be combined with a a second pesticide (e.g., nematocide, fungicide, insecticide, algaecide, miticide, or bactericide). Such an agent can be a natural oil or oil-product having fungicidal, bactericidal, nematicidal, acaricidal and/or insecticidal activity (e.g., paraffinic oil, tea tree oil, lemongrass oil, clove oil, cinnamon oil, citrus oil, rosemary oil, pyrethram). Furthermore, the pesticide can be a single site anti-fungal agent which may include but is not limited to benzimidazole, a demethylation inhibitor (DMI) (e.g., imidazole, piperazine, pyrimidine, triazole), morpholine, hydroxypyrimidine, anilinopyrimidine, phosphorothiolate, quinone outside inhibitor, quinoline, dicarboximide, carboximide, phenylamide, anilinopyrimidine, phenylpyrrole, aromatic hydrocarbon, cinnamic acid, hydroxyanilide, antibiotic, polyoxin, acylamine, phthalimide, benzenoid (xylylalanine); a demethylation inhibitor selected from the group consisting of imidazole, piperazine, pyrimidine and triazole (e.g.,bitertanol, myclobutanil, penconazole, propiconazole, triadimefon, bromuconazole, cyproconazole, diniconazole, fenbuconazole, hexaconazole, tebuconazole, tetraconazole), myclobutanil, an anthranilic diamide (e.g., chlorantranilipole) and a quinone outside inhibitor (e.g., strobilurin). The strobilurin may include but is not limited to azoxystrobin, kresoxim-methoyl or trifloxystrobin. In yet another particular embodiment, the anti-fungal agent is a quinone, e.g., quinoxyfen (5,7-dichloro-4-quinolyl 4-fluorophenyl ether). The anti-fungal agent can also be derived from a *Reynoutria* extract.

The fungicide can also be a multi-site non-inorganic, chemical fungicide selected from the group consisting of chloronitrile, quinoxaline, sulphamide, phosphonate, phosphite, dithiocarbamate, chloralkythios, phenylpyridinamine, and cyano-acetamide oxime.

The composition can, as noted above, further comprise an insecticide. The insecticide can include but is not limited to avermectin, Bt (e.g., *Bacillus thuringiensis* var. *kurstaki*), neem oil, spinosads, *Burkholderia* sp. (e.g., as set forth in WO2011/106491), entomopathogenic fungi such a *Beauveria bassiana* and chemical insecticides including but not limited to organochlorine compounds, organophosphorous compounds, carbamates, pyrethroids, pyrethrins and neonicotinoids.

As noted above, the composition may further comprise a nematocide. This nematocide may include, but is not limited to, avermectin, microbial products such as Biome (*Bacillus firmus*), *Pasteuria* spp and organic products such as saponins.

Methods for modulating pest infestation Thus, according to the present disclosure, methods for modulating pest infestation in a plant are provided. The methods comprise application to a plant, or to the soil or substrate in which the plant is growing, of a pesticidal composition comprising a nucleic acid as disclosed herein; i.e., any of SEQ ID NOs: 1-4533, or any of the nucleic acids of embodiments 1-7, 15-17 and 49-52, or any of the vectors of embodiments 8 and 9.

Additional methods for modulating pest infestation in a plant comprise application, to a plant, or to the soil or substrate in which the plant is growing, of a pesticidal composition comprising a polypeptide as disclosed herein; i.e., any of SEQ ID NOs:4534-8960, or any of the polypeptides of embodiments 10-14 and 53.

When used as biological insect control agents, insecticidal toxins encoded by the *C. subtsugae* genome can be produced by expression of a *C. subtsugae* nucleotide sequence in a heterologous host cell capable of expressing the nucleotide sequences. In one embodiment, one or more *C. subtsugae* nucleotide sequences are inserted into an appropriate expression cassette comprising, e.g., a promoter and a transcriptional termination signal. Expression of the nucleotide sequence(s) can be constitutive or inducible, depending on the promoter and/or external stimuli. In certain embodiments, the cell in which the toxin is expressed is a microorganism, such as a virus, a *bacterium,* or a fungus.

In certain embodiments, a virus, such as a baculovirus, is engineered to contain a *C. subtsugae* nucleotide sequence in its genome. Such a recombinant virus can express large amounts of, e.g., an insecticidal toxin after infection of appropriate eukaryotic cells that are suitable for virus replication and expression of the nucleotide sequence. The insecticidal toxin thus produced is used as an insecticidal agent. Alternatively, baculoviruses engineered to include the nucleotide sequence are used to infect insects in vivo and kill them, either by expression of the insecticidal toxin or by a combination of viral infection and expression of the insecticidal toxin.

Thus, the compositions set forth above, comprising *C. subtsugae* nucleic acids and polypeptides, can be used as pesticides. In particular, the compositions as set forth above can be used as, for example, insecticides and nematicides, alone or in combination with one or more second pesticidal substances as set forth herein.

Specifically, nematodes that may be controlled using the method set forth above include but are not limited to parasitic nematodes such as root-knot, cyst, and lesion nematodes, including but not limited to seed gall nematodes (*Afrina wevelli*), bentgrass nematodes (*Anguina agrostis*), shoot gall nematodes (*Anguina* spp.), seed gall nematodes (*Anguina* spp., *A. amsinckiae, A. balsamophila; A. tritici*), fescue leaf gall nematodes (*A. graminis*), ear-cockle (or wheat gall) nematodes (*Anguina tritici*), bud and leaf (or foliar) nematodes (*Aphelenchoides* spp., *A. subtenuis*), begonia leaf (or fern, or spring crimp, or strawberry foliar, or strawberry nematodes, or summer dwarf) nematodes (*A. fragariae*), fern nematodes (*A. olesistus*), rice nematodes (*A. oryzae*), currant nematodes (*A. ribes*), black currant (or chrysanthemum) nematodes (*A. ritzemabosi*), chrysanthemum foliar or leaf nematodes (*A. ritzemabosi*), rice white-tip (or spring dwarf, or strawberry bud) nematodes (*A. besseyi*), fungus-feeding (mushroom) nematodes (*Aphelenchoides composticola*), *Atalodera* spp. (*Atalodera lonicerae, Atalodera ucri*), spine nematodes (*Bakernema variabile*), sting nematodes (*Belonolaimus* spp., *B. gracilis, B. longicaudatus*), pine wood nematodes (*Bursaphalenchus* spp., *B. xylo-*

*philus, B. mucronatus*), sessile nematodes (*Cacopaurus* spp., *C. epacris, C. pestis*), amaranth cyst nematodes (*Cactodera amaranthi*), birch cyst nematodes (*C. betulae*), cactus cyst nematodes (*C. cacti*), estonian cyst nematodes (*C. estonica*), Thorne's cyst nematodes (*C. thornei*), knotweed cyst nematodes (*C. weissi*), ring nematodes (*Criconema* spp.), spine nematodes (*Criconema* spp., *C. civellae, C. decalineatum, C. spinalineatum*), ring nematodes (*Criconemella axeste, C. curvata, C. macrodora, C. parva*), ring nematodes (*Criconemoides* spp., *C. citri, C. simile*), spine nematodes (*Crossonema fimbriatum*), eucalypt cystoid nematodes (*Cryphodera eucalypti*), bud, stem and bulb nematodes (*Ditylenchus* spp., *D. angustus, D. dipsaci, D. destructor, D. intermedius*), Mushroom spawn nematodes (*D. myceliophagus*), awl nematodes (*Dolichodorus* spp., *D. heterocephalus, D. heterocephalous*), spear nematodes (*Dorylaimus* spp.), stunt nematodes (*Geocenamus superbus*), cyst nematodes (*Globodera* spp.), yarrow cyst nematodes (*G. achilleae*), milfoil cyst nematodes (*G. millefolii*), apple cyst nematodes (*G. mali*), white cyst potato nematodes (*G. pallida*), golden nematodes (*G. rostochiensis*), tobacco cyst nematodes (*G. tabacum*), Osborne's cyst nematodes (*G. tabacum solanacearum*), horsenettle cyst nematodes (*G. tabacum virginiae*), pin nematodes (*Gracilacus* spp., *G. idalimus*), spiral nematodes (*Helicotylenchus* spp., *H. africanus, H. digonicus, H. dihystera, H. erythrinae, H. multicinctus, H. paragirus, H. pseudorobustus, H. solani, H. spicaudatus*), sheathoid nematodes (*Hemicriconemoides* spp., *H. biformis, H. californianus, H. chitwoodi, H. floridensis, H. wessoni*),sheath nematodes (*Hemicycliophora* spp., *H. arenaria, H. biosphaera, H. megalodiscus, H. parvana, H. poranga, H. sheri, H. similis, H. striatula*), cyst nematodes (*Heterodera* spp.), almond cyst nematodes (*H. amygdali*), oat (or cereal) cyst nematodes (*H. avenae*), Cajanus (or pigeon pea) cyst nematodes (*H. cajani*), bermudagrass (or heart-shaped, or Valentine) cyst nematodes (*H. cardiolata*), carrot cyst nematodes (*H. carotae*), cabbage cyst nematodes or brassica root eelworm (*H. cruciferae*), nutgrass (or sedge) cyst nematodes (*H. cyperi*), Japanese cyst nematodes (*H. elachista*), fig (or ficus, or rubber) cyst nematodes (*H. fici*), galeopsis cyst nematodes (*H. galeopsidis*), soybean cyst nematodes (*H. glycines*), alfalfa root (or pea cyst) nematodes (*H. goettingiana*), buckwheat cyst nematodes (*H. graduni*), barley cyst nematodes (*H. hordecalis*), hop cyst nematodes (*H. humuli*), Mediterranean cereal (or wheat) cyst nematodes (*H. latipons*), lespedeza cyst nematodes (*H. lespedezae*), Kansas cyst nematodes (*H. longicolla*), cereals root eelworm or oat cyst nematodes (*H. major*), grass cyst nematodes (*H. mani*), lucerne cyst nematodes (*H. medicaginis*), cyperus (or motha) cyst nematodes (*Heterodera mothi*), rice cyst nematodes (*H. oryzae*), Amu-Darya (or camel thorn cyst) nematodes (*H. oxiana*), dock cyst nematodes (*H. rosii*), rumex cyst nemtodes (*H. rumicis*), sugar beet cyst nematodes (*H. schachtii*), willow cyst nematodes (*H. salixophila*), knawel cyst nematodes (*H. scleranthii*), sowthistle cyst nematodes (*H. sonchophila*), tadzhik cyst nematodes (*H. tadshikistanica*), turkmen cyst nematodes (*H. turcomanica*), clover cyst nematodes (*H. trifolii*), nettle cyst nematodes (*H. urticae*), ustinov cyst nematodes (*H. ustinovi*), cowpea cyst nematodes (*H. vigni*), corn cyst nematodes (*H. zeae*), rice root nematodes (*Hirschmanniella* spp., *H. belli, H. caudacrena, H. gracilis, H. oryzae*), lance nematodes (*Hoplolaimus* spp.), Columbia nematodes (*H. columbus*), Cobb's lance nematodes (*H. galeatus*), crown-headed lance nematodes (*H. tylenchiformis*), pseudo root-knot nematodes (*Hypsoperine graminis*), needle nematodes (*Longidorus* spp., *L. africanus, L. sylphus*), ring nematodes (*Macroposthonia* (=*Mesocriconema*) *xenoplax*), cystoid nematodes (*Meloidodera* spp.), pine cystoid nematodes (*M. floridensis*), tadzhik cystoid nematodes (*M. tadshikistanica*), cystoid body nematodes (*Meloidoderita* spp.), stunt nematodes (*Merlinius* spp., *M. brevidens, M. conicus, M. grandis, M. microdorus*), root-knot nematodes (*Meloidogyne* spp., *M. acronea, M. arenaria, M. artiellia, M. brevicauda, M. camelliae, M. carolinensis, M. chitwoodi, M. exigua, M. graminicola, M. hapla, M. hispanica, M. incognita, M. incognita acrita, M. indica, M. inornata, M. javanica, M. kikuyuensis, M. konaensis, M. mali, M. microtyla, M. naasi, M. ovalis, M. platani, M. querciana, M. sasseri, M. tadshikistanica, M. thamesi*), knapweed nematodes (*Mesoanguina picridis*), Douglas fir nematodes (*Nacobbodera chitwoodi*), false root-knot nematodes (*Nacobbus aberrans, N. batatiformis, N. dorsalis*), sour paste nematodes (*Panagrellus redivivus*), beer nematodes (*P. silusiae*), needle nematodes (*Paralongidorus microlaimus*), spiral nematodes (*Pararotylenchus* spp.), stubby-root nematodes (*Paratrichodorus allius, P. minor, P. porosus, P. renifer*), pin nematodes (*Paratylenchus* spp., *P. baldaccii, P. bukowinensis, P. curvitatus, P. dianthus, P. elachistus, P. hamatus, P. holdemani, P. italiensis, P. lepidus, P. nanus, P. neoamplycephalus, P. similis*), lesion (or meadow) nematodes (*Pratylenchus* spp., *P. alleni, P. brachyurus, P. coffeae, P. convallariae, P. crenatus, P. flakkensis, P. goodeyi, P. hexincisus, P. leiocephalus, P. minyus, P. musicola, P. neglectus, P. penetrans, P. pratensis, P. scribneri, P. thornei, P. vulnus, P. zeae*), stem gall nematodes (*Pterotylenchus cecidogenus*), grass cyst nematodes (*Punctodera punctate*), stunt nematodes (*Quinisulcius acutus, Q. capitatus*), burrowing nematodes (*Radopholus* spp.), banana-root nematodes (*R. similis*), rice-root nematodes (*R. oryzae*), red ring (or coconut, or cocopalm) nematodes (*Rhadinaphelenchus cocophilus*), reniform nematodes (*Rotylenchulus* spp., *R. reniformis, R. parvus*), spiral nematodes (*Rotylenchus* spp., *R. buxophilus, R. christiei, R. robustus*), Thorne's lance nematodes (*R. uniformis*), *Sarisodera hydrophylla,* spiral nematodes (*Scutellonema* spp., *S. blaberum, S. brachyurum, S. bradys, S. clathricaudatum, S. christiei, S. conicephalum*), grass root-gall nematodes (*Subanguina radicicola*), round cystoid nematodes (*Thecavermiculatus andinus*), stubby-root nematodes (*Trichodorus* spp., *T. christiei, T. kurumeensis, T. pachydermis, T. primitivus*), vinegar eels (or nematodes) (*Turbatrix aceti*), stunt (or stylet) nematodes (*Tylenchorhynchus* spp., *T. agri, T. annulatus, T. aspericutis, T. claytoni, T. ebriensis, T. elegans, T. golden, T. graciliformis, T. martini, T. mashhoodi, T. microconus, T. nudus, T. oleraceae, T. penniseti, T. punensis*), citrus nematodes (*Tylenchulus semipenetrans*), and dagger nematodes (*Xiphinema* spp., *X. americanum, X. bakeri, X. brasiliense, X. brevicolle, X. chambersi, X. coxi, X. diversicaudatum X. index, X. insigne, X. nigeriense, X. radicicola, X. setariae, X. vulgarae, X. vuittenezi*).

Phytopathogenic insects controlled by the methods set forth above include but are not limited to non-*Culicidae* larvae insects from the order (a) Lepidoptera, for example, *Acleris* spp., *Adoxophyes* spp., *Aegeria* spp., *Agrotis* spp., *Alabama argillaceae, Amylois* spp., *Anticarsia gemmatalis, Archips* spp., *Argyrotaenia* spp., *Autographa* spp., *Busseola fusca, Cadra cautella, Carposina nipponensis, Chilo* spp., *Choristoneura* spp., *Clysia ambiguella, Cnaphalocrocis* spp., *Cnephasia* spp., *Cochylis* spp., *Coleophora* spp., *Crocidolomia binotalis, Cryptophlebia leucotreta, Cydia* spp., *Diatraea* spp., *Diparopsis castanea, Earias* spp., *Ephestia* spp., *Eucosma* spp., *Eupoecilia ambiguella, Euproctis* spp., *Euxoa* spp., *Grapholita* spp., *Hedya nubiferana, Heliothis* spp., *Hellula undalis, Hyphantria cunea, Keiferia lycopersicella, Leucoptera scitella, Lithocollethis* spp., *Lobesia botrana, Lymantria* spp., *Lyonetia* spp., *Malacosoma* spp., *Mamestra brassicae, Manduca sexta, Operophtera* spp., *Ostrinia nubilalis, Pammene* spp., *Pandemis* spp., *Panolis flammea, Pectinophora gossypiella, Phthorimaea operculella, Pieris rapae, Pieris* spp., *Plutella xylostella, Prays* spp., *Scirpophaga* spp., *Sesamia* spp., *Sparganothis* spp., *Spodoptera* spp., *Synanthedon* spp., *Thaumetopoea* spp., *Tortrix* spp., *Trichoplusia ni* and *Yponomeuta* spp.; (b) Coleoptera, for example, *Agriotes* spp., *Anthonomus* spp., *Atomaria linearis, Chaetocnema tibialis, Cosmopolites* spp., *Curculio* spp., *Dermestes* spp., *Diabrotica* spp., *Epilachna* spp., *Eremnus* spp., *Leptinotarsa decemlineata, Lissorhoptrus* spp., *Melolontha* spp., *Orycaephilus* spp., *Otiorhynchus* spp., *Phlyctinus* spp., *Popillia* spp., *Psylliodes* spp., *Rhizopertha* spp-, *Scarabeidae, Sitophilus* spp., *Sitotroga* spp., *Tenebrio* spp., *Tribolium* spp. and *Trogoderma* spp.; (c) Orthoptera, for example, *Blatta* spp., *Blattella* spp., *Gryllotalpa* spp., *Leucophaea maderae, Locusta* spp., *Periplaneta* spp. and *Schistocerca* spp.; (d) Isoptera, for example, *Reticulitermes* spp.; (e) Psocoptera, for example, *Liposcelis* spp.; (f) Anoplura, for example, *Haematopinus* spp., *Linognathus* spp., *Pediculus* spp., *Pemphigus* spp. and *Phylloxera* spp.; (g) Mallophaga, for example, *Damalinea* spp. and *Trichodectes* spp.; (h) Thysanoptera, for example, *Frankliniella* spp., *Hercinotnrips* spp., *Taeniothrips* spp., *Thrips palmi, Thrips tabaci* and *Scirtothrips aurantii;* (i) Heteroptera, for example, *Cimex* spp., *Distantiella theobroma, Dysdercus* spp., *Euchistus* spp., *Eurygaster* spp., *Leptocorisa* spp., *Nezara* spp., *Piesma* spp., *Rhodnius* spp., *Sahlbergella singularis, Scotinophara* spp. and *Tniatoma* spp.; (j) Homoptera, for example, *Aleurothrixus floccosus, Aleyrodes brassicae, Aonidiella* spp., *Aphididae, Aphis* spp., *Aspidiotus* spp., *Bemisia tabaci, Ceroplaster* spp., *Chrysomphalus aonidium, Chrysomphalus dictyospermi, Coccus hesperidum, Empoasca* spp., *Eriosoma larigerum, Erythroneura* spp., *Gascardia* spp., *Laodelphax* spp., *Lecanium corni, Lepidosaphes* spp., *Macrosiphus* spp., *Myzus* spp., *Nephotettix* spp., *Nilaparvata* spp., *Paratoria* spp., *Pemphigus* spp., *Planococcus* spp., *Pseudaulacaspis* spp., *Pseudococcus* spp., *Psylla* spp., *Pulvinaria aethiopica, Quadraspidiotus* spp., *Rhopalosiphum* spp., *Saissetia* spp., *Scaphoideus* spp., *Schizaphis* spp., *Sitobion* spp., *Trialeurodes vaporariorum, Trioza erytreae* and *Unaspis citri;* (k) Hymenoptera, for example, *Acromyrmex, Atta* spp., *Cephus* spp., *Diprion* spp., *Diprionidae, Gilpinia polytoma, Hoplocampa* spp., *Lasius* spp., *Monomorium pharaonis, Neodiprion* spp., *Solenopsis* spp. and *Vespa* spp.; (l) Diptera, for example, *Aedes* spp., *Antherigona soccata, Bibio hortulanus, Calliphora erythrocephala, Ceratitis* spp., *Chrysomyia* spp., *Culex* spp., *Cuterebra* spp., *Dacus* spp., *Drosophila melanogaster, Fannia* spp., *Gastrophilus* spp., *Glossina* spp., *Hypoderma* spp., *Hyppobosca* spp., *Liriomyza* spp., *Lucilia* spp., *Melanagromyza* spp., *Musca* spp., *Oestrus* spp., *Orseolia* spp., *Oscinella frit, Pegomyia hyoscyami, Phorbia* spp., *Rhagoletis pomonella, Sciara* spp., *Stomoxys* spp., *Tabanus* spp., *Tannia* spp. and *Tipula* spp.; (m) Siphonaptera, for example, *Ceratophyllus* spp. and *Xenopsylla cheopis* and (n) from the order Thysanura, for example, *Lepisma saccharina.*

The pesticidal compositions disclosed herein may further be used for controlling crucifer flea beetles (*Phyllotreta* spp.), root maggots (*Delia* spp.), cabbage seedpod weevil (*Ceutorhynchus* spp.) and aphids in oil seed crops such as canola (rape), mustard seed, and hybrids thereof, and also rice and maize. In a particular embodiment, the insect is a member of the *Spodoptera,* more particularly, *Spodoptera exigua, Myzus persicae, Plutella xylostella* or *Euschistus* sp.

Application of an effective pesticidal control amount of a pesticidal composition as disclosed herein is provided. Said pesticidal composition is applied, alone or in combination with another pesticidal substance, in an effective pest control or pesticidal amount. An effective amount is defined as that quantity of pesticidal composition, alone or in combination with another pesticidal substance, that is sufficient to prevent or modulate pest infestation. The effective amount and rate can be affected by pest species present, stage of pest growth, pest population density, and environmental factors such as temperature, wind velocity, rain, time of day and seasonality. The amount that will be within an effective range in a particular instance can be determined by laboratory or field tests.

Methods of application The pesticidal compositions disclosed herein, when used in methods for modulating pest infestation, can be applied using methods known in the art. Specifically, these compositions can be applied to plants or plant parts by spraying, dipping, application to the growth substrate (e.g., soil) around the plant, application to the root zone, dipping roots prior to planting, application to plants as a turf or a drench, through irrigation, or as soil granules. Plants are to be understood as meaning in the present context all plants and plant populations such as desired and undesired wild plants or crop plants (including naturally occurring crop plants). Crop plants can be plants obtained by conventional plant breeding and optimization methods, by biotechnological and genetic engineering methods or by combinations of these methods, including transgenic plants and plant cultivars protectable or not protectable by plant breeders' rights. Plant parts are to be understood as meaning all parts and organs of plants above and below the ground, such as shoot, leaf, flower and root, examples which may be mentioned being leaves, needles, stalks, stems, flowers, fruit bodies, fruits, seeds, roots, tubers and rhizomes. The plant parts also include harvested material, and vegetative and generative propagation material, for example cuttings, tubers, rhizomes, off-shoots and seeds.

Application can be external, (e.g. by spraying, fogging or painting) or internal (e.g., by injection, transfection or the use of an insect vector). When applied internally, the compositions can be intracellular or extracellular (e.g., present in the vascular system of the plant, present in the extracellular space).

Treatment of the plants and plant parts with the compositions set forth above can be carried out directly or by allowing the compositions to act on a plant's surroundings, habitat or storage space by, for example, immersion, spraying, evaporation, fogging, scattering, painting on, injecting. In the case in which the composition is applied to a seed, the composition can be applied to the seed as one or more coats prior to planting the seed using methods known in the art.

Pesticidal compositions as disclosed herein can also be applied to seeds; e.g., as a seed coating. Different adherents ("stickers") can be used in the manufacture of seed coatings, including, for example, methyl cellulose, alginate, carrageenan and polyvinyl alcohol. The adherent is dissolved in water to a percentage between 1-10% and stored at room temperature before application to the seeds. Seeds are soaked in adherent solution (3 ml/100 seeds) for 15 min, scooped out and mixed with organic matter (1.5 g/100 seeds) in plastic bags and shaken vigorously. This process can also be automated using a seed coating machine.

For priming seeds with compositions as disclosed herein, seeds are soaked in twice the seed volume of sterile distilled water containing bacterial/protein/nucleic acid suspensions or talc formulation (dry formulation) (4-10 g $kg^{-1}$ of seed, depending on seed size) and incubated at 25±2° C. for 12-24 h. The suspension is then drained off and the seeds are dried under shade for 30 min and used for sowing.

The compositions can also be used as soil amendments, e.g., in combination with a carrier such as a talc formulation. Formulations for soil amendment can also include clays, emulsifiers, surfactants and stabilizers, as are known in the art. For preparation of talc based formulations, one kg of purified talc powder (sterilized for 12 h), 15 g calcium carbonate, and 10 g carboxymethyl cellulose are mixed under aseptic conditions following the method described by Nandakumar et al. (2001). Protein, nucleic acid suspensions or organisms expressing these are mixed in a 1:2.5 ratio (suspension to dry mix) and the product is shade-dried to reduce moisture content to 20-35%.

For soil amendment, formulations (e.g., talc formulations) can be applied at rates between 2.5-10 Kg $ha^{-1}$ at sowing and/or at different times after emergence, or both, depending on the crops.

The compositions disclosed herein can also be applied to soil using methods known in the art. See, for example, the USDA website at naldc.nal.usda.gov/download/43874/pdf, accessed Feb. 20, 2013. Such methods include but are not limited to fumigation, drip irrigation or chemigation, broadcast application of granules or sprays, soil incorporation (e.g., application of granules), soil drenching, seed treatment and dressing, and bare root dip.

Plant Transformation The nucleic acids disclosed herein can be introduced into, and optionally expressed in, plants, using any of a number of plant transformation techniques. Transformation of plants can be undertaken with a single DNA species or multiple DNA species (i.e., co-transformation).

In certain embodiments, a *C. subtsugae* protein or polypeptide (e.g., a toxin) is expressed in a plant and provides protection to the plant from insect pests. For example, a nucleotide sequence as disclosed herein can be inserted into an expression cassette, which can optionally be stably integrated into the chromosome of a plant. In certain embodiments, the nucleotide sequence is included in a non-pathogenic self-replicating virus. Plants transformed in accordance with the present disclosure can be monocots or dicots and include but are not limited to, maize, wheat, barley, rye, sweet potato, bean, pea, chicory, lettuce, cabbage, cauliflower, broccoli, turnip, radish, spinach, asparagus, onion, garlic, pepper, celery, squash, pumpkin, hemp, zucchini, apple, pear, quince, melon, plum, cherry, apricot, strawberry, papaya, avocado, mango, banana, alfalfa, rice, potato, eggplant, peach, cotton, carrot, tobacco, sorghum, nectarine, sugar beet, sugarcane, sunflower, soybean, tomato, pineapple, grape, raspberry, blackberry, cucumber, *Arabidopsis,* and woody plants such as coniferous and deciduous trees.

Once the desired nucleotide sequence has been introduced into a particular plant species, it can be propagated in that species, or transferred to other varieties of the same species, particularly including commercial varieties, using traditional breeding techniques.

DNA can be introduced into plant cells through the use of a number of art-recognized methods. Those skilled in the art will appreciate that the choice of methods can depend on the type of plant targeted for transformation. Suitable methods for transforming plant cells are as follows.

*Agrobacterium*-mediated transformation A major method of DNA transfer in plants is *Agrobacterium* mediated transformation. The natural living soil *bacterium Agrobacterium tumefaciens* is capable of infecting a wide range of plant species, causing Crown Gall diseases. When *A. tumefaciens* infects a cell, it transfers a copy of its T-DNA, which is a small section of DNA carried on its Ti (Tumor Inducing) plasmid. The T-DNA is flanked by two (imperfect) 25 base pair repeats. Any DNA contained within these borders will be transferred to the host cell. Zupan and Zambriski, 1995. The T-DNA section on the Ti plasmid can be replaced by a transgene attached to an appropriate regulatory sequence(s). Recombinant *A. tumeficiens* containing a Ti plasmid comprising exogenous nucleotide sequences can then be used to infect cultures of either regenerating cell or protoplasts (i.e., wall-less spherical plant cells). Marker genes such as those coding for antibiotic resistance can be included in the Ti plasmid construct, so that it is possible to select cells that have been transformed by the *bacterium.* Cell-to-plant regeneration is carried out on the selected cells by standard methods. See, for example, Zupan and Zambriski (1995) and Jones et al. (2005) Plant Methods.

*Agrobacterium tumefaciens* can used to transform many dicotyledonous plant species with relative ease. Hinchee et al., Biotechnology 6:915-921 (1988). See also Ishida et al., Nature Biotechnology 14:745-750 (June 1996) for a description of maize transformation.

Biolistic delivery This method, also known as "particle bombardment," involves directly "shooting" a DNA molecule into the recipient plant tissue, using a "gene gun." Tungsten or gold beads (which are smaller than the plant cells themselves) are coated with the DNA of interest and fired through a stopping screen, accelerated by Helium, into the plant tissue. The particles pass through the plant cells, leaving the DNA inside. This method can be used on both monocotyledonous and dicotyledonous species successfully. Transformed tissue can be selected using marker genes such as those encoding antibiotic resistance. Whole plants, containing a copy of the transgene in all cells, can be regenerated from the totipotent transformed cells in culture (Nottingham, 1998), using devices available from Agracetus, Inc. (Madison, Wis.) and Dupont, Inc. (Wilmington, Del.).

Methods for biolistic plant transformation are well-known in the art. See, for example, Sanford et al., U.S. Pat. No. 4,945,050; McCabe et al., Biotechnology 6.923-926 (1988); Weissinger et al., Annual Rev Genet. 22-421-477 (1988); Sanford et al., Particulate Science and Technology 5.27-37 (1987)(onion); Svab et al., Proc. Natl. Acad. Sci. USA 87-8526-8530 (1990) (tobacco chloroplast); Christou et al., Plant Physiol 87,671-674 (1988) (soybean); McCabe et al., BioTechnology 6.923-926 (1988) (soybean); Klein et al., Proc. Natl. Acad. Sci. USA, 85:4305-4309 (1988) (maize); Klein et al., BioTechnology 6,559-563 (1988) (maize); Klein et al., Plant Physiol. 91,440-444 (1988) (maize); Fromm et al., BioTechnology 8:833-839 (1990); Gordon-Kamm et al., Plant Cell 2: 603-618 (1990) (maize); Koziel et al., Biotechnology 11: 194-200 (1993) (maize); Shimamoto et al., Nature 338: 274-277 (1989) (rice); Christou et al., Biotechnology 9: 957-962 (1991) (rice); Datta et al., BioTechnology 8.736-740 (1990) (rice); European Patent Application EP 0 332 581 (orchardgrass and other Pooideae); Vasil et al., Biotechnology 11: 1553-1558 (1993) (wheat); Weeks et al., Plant Physiol. 102:1077-1084 (1993) (wheat); Wan et al., Plant Physiol. 104:37-48 (1994) (barley); Jahne et al., Theor. Appl. Genet. 89:525-533 (1994) (barley); Umbeck et al., BioTechnology 5:263-266 (1987) (cotton); Casas et al., Proc. Natl. Acad. Sci. USA 90:11212-11216 (December 1993) (sorghum); Somers et al., BioTechnology 10:1589-1594 (December 1992) (oat); Torbert et al., Plant Cell Reports 14:635-640 (1995) (oat); Weeks et al., Plant Physiol. 102:1077-1084 (1993) (wheat); Chang et al., WO 94/13822 (wheat) and Nehra et al., The Plant Journal 5:285-297 (1994) (wheat).

Methods for the introduction of recombinant DNA molecules into maize by microprojectile bombardment can be found in Koziel et al., Biotechnology 11: 194-200(1993), Hill et al., Euphytica 85:119-123 (1995) and Koziel et al., Annals of the New York Academy of Sciences 792:164-171 (1996).

Protoplast transformation and other methods Another method for the introduction of nucleic acid molecules into plants is the protoplast transformation method for maize as disclosed in EP 0 292 435. Additional delivery systems for gene transfer in plants include electroporation (Riggs et al., Proc. Natl. Acad, Sci. USA 83,5602-5606 (1986), microinjection (Crossway et al., BioTechniques 4,320-334 (1986), silicon carbide-mediated DNA transfer, direct gene transfer (Paszkowski et al., EMBO J. 3.2717-2722 (1984); Hayashimoto et al., Plant Physiol 93.857-863 (1990) (rice).

Plastid Transformation In another embodiment, a nucleotide sequence as disclosed herein is directly transformed into the genome of a plastid (e.g., chloroplast). Advantages of plastid transformation include the ability of plastids to express bacterial genes without substantial modification of the bacterial sequences, and the ability of plastids to express multiple open reading frames under the control of a single promoter. Plastid transformation technology is described in U.S. Pat. Nos. 5,451,513; 5,545,817 and 5,545,818; in PCT application No. WO 95/16783, and in McBride et al. (1994) Proc. Natl. Acad. Sci. USA 91, 7301-7305.

The basic technique for chloroplast transformation involves introducing regions of cloned plastid DNA flanking a selectable marker, together with the gene of interest, into a suitable target tissue using, e.g., biolistics or protoplast transformation (e.g., calcium chloride or PEG mediated transformation). The 1 to 1.5 kb flanking regions, termed targeting sequences, facilitate homologous recombination with the plastid genome and thus allow the replacement or modification of specific regions of the plastid genome. Initially, point mutations in the chloroplast 16S rRNA and rps12 genes conferring resistance to spectinomycin and/or streptomycin were utilized as selectable markers for transformation (Svab, Z. et al. (1990) Proc. Natl. Acad. Sci. USA 87, 8526-8530; Staub, J. M., and Maliga, P. (1992) Plant Cell 4, 39-45); resulting in the production of stable homoplasmic transformants at a frequency of approximately one per 100 bombardments of target leaves. The presence of cloning sites between these markers allowed creation of a plastid targeting vector for introduction of foreign genes. Staub, J. M., and Maliga, P. (1993) EMBO J. 12: 601-606. Substantial increases in transformation frequency were obtained by replacement of the recessive rRNA or r-protein antibiotic resistance genes with a dominant selectable marker, the bacterial AADA gene encoding the spectinomycin-detoxifying enzyme aminoglycoside-3' adenyltransferase. Svab, Z., and Maliga, P. (1993) Proc. Natl. Acad. Sci. USA 90: 913-917. Previously, this marker had been used successfully for high-frequency transformation of the plastid genome of the green alga *Chlamydomonas reinhardtii*. Goldschmidt-Clermont, M. (1991) Nucl. Acids Res. 19: 4083-4089.

Other selectable markers useful for plastid transformation are known in the art and encompassed within the scope of the present disclosure. Typically, approximately 15-20 cell division cycles following transformation are required to reach a homoplastidic state. Plastid expression, in which genes are inserted by homologous recombination into all of the several thousand copies of the circular plastid genome present in each plant cell, takes advantage of the enormous copy number advantage, compared to nuclear genes, to achieve expression levels that can readily exceed 10% of the total soluble plant protein. Thus, in certain embodiments, a nucleotide sequence as disclosed herein is inserted into a plastid targeting vector and transformed into the plastid genome of a desired plant host. Plants homoplastic for plastid genomes containing a nucleotide sequence of interest are obtained, and are capable of high-level expression of the nucleotide sequence.

Magnifection Magnifection is a transient expression process that is based on expression from viral RNA replicons delivered into plant cells systemically using *Agrobacterium*. This method allows production of recombinant proteins at yields up to 5 g per kg of fresh leaf biomass, which approaches the biological limits for protein expression. Such high yields are possible because of the transient nature of the process, which allows the use of very potent amplicons derived from RNA viruses such as Tobacco mosaic virus (TMV) or Potato virus X, without limiting biomass accumulation, which takes place prior to infection. See, e.g., Marillonnet et al. (2005) *Nature Biotechnol.* 23(6):718-723.

Additional disclosure of methods and compositions for plant genetic engineering is provided in Bircher, J A (ed.) "Plant Chromosome Enginerering: Methods and protocols." *Methods in Molecular Biology*, vol. 701, Springer Science+Business Media, 2011.

Computerized systems and media Disclosed herein are computer readable media comprising the sequence information of any of the nucleic acids disclosed herein; i.e., any of SEQ ID NOs:1-4533, any of the nucleic acids of embodiments 1-7, 15-17 and 49-52, and any of the vectors of embodiments 8 and 9. In addition, the present disclosure includes computer-readable media comprising the amino acid sequence information of any of the polypeptides disclosed herein; i.e., any of SEQ ID NOs:4534-8960 and any of the polypeptides of embodiments 10-14 and 53. Such media include magnetic, optical, digital, electrical and hybrid media.

Also provided are computerized systems and computer program products containing the nucleic acids and polypeptide sequences disclosed herein on a computer-readable medium. The computer systems can be local systems involving a single computer connected to a database of the sequences disclosed herein, intranet systems, or systems including external computers connected via the Internet. Such systems are used, for example, to facilitate comparisons of the sequences disclosed herein with other known or unknown sequences.

Thus, a variety of computer systems designed to facilitate analyses using the disclosed sequences are provided. Some systems include a memory, a system bus, and a processor. In certain embodiments, the processor is operatively disposed to: (i) compare one or more nucleotide sequences as disclosed herein with one or more second nucleotide sequences; (ii) identify identical or homologous sequences; and (iii) display the identified nucleotide sequence(s).

In additional embodiments, the processor is operatively disposed to: (i) compare one or more polypeptide sequences as disclosed herein with one or more second polypeptide sequences; (ii) identify identical or homologous sequences; and (iii) display the identified polypeptide sequence(s).

Also provided are computer systems that generally include a database and a user interface. The database in such systems comprises sequence records that include an identifier that identifies one or more projects to which each of the nucleotide or amino acid sequence records belong. The user interface permits a user to input identifying information specifying which of the nucleotide or amino acid sequences are to be compared. It is also is also capable of displaying the identified polynucleotide(s) or polypeptide(s).

Still other computer systems include a memory, a system bus, and a processor. The processor in such systems is operatively disposed to: (i) compare one or more polynucleotide sequences as disclosed herein with one or more known sequences to assess sequence similarity between one or more of the polynucleotide sequences as disclosed herein and the one or more known sequences; and (ii) display information concerning the sequence similarity between the one or more of the polynucleotide sequences disclosed herein and the one or more known sequences.

In additional embodiments, computer systems include a memory, a system bus, and a processor. The processor in such systems is operatively disposed to: (i) compare one or more polypeptide sequences as disclosed herein with one or more known sequences to assess sequence similarity between one or more of the polypeptide sequences as disclosed herein and the one or more known sequences; and (ii) display information concerning the sequence similarity between the one or more of the polypeptide sequences disclosed herein and the one or more known sequences.

In addition to the various computer systems for conducting analyses and comparisons, also provided are various computer program products for conducting the analyses and comparisons. Certain of the computer program products include program instructions for analyzing polynucleotide sequences by performing the following: (a) providing or receiving one or more of the nucleotide sequences disclosed herein; (b) providing or receiving a second nucleotide sequence; (c) determining the degree of homology or identity between the first nucleotide sequence and the second nucleotide sequence; and (d) displaying information concerning the degree of homology or identity between the two nucleotide sequences.

In additional embodiments, computer program products include program instructions for analyzing polypeptide sequences by performing the following: (a) providing or receiving one or more of the amino acid sequences disclosed herein; (b) providing or receiving a second amino acid sequence; (c) determining the degree of homology or identity between the first amino acid sequence and the second amino acid sequence; and (d) displaying information concerning the degree of homology or identity between the two amino acid sequences.

Also provided is a computer program product comprising a computer-useable medium and computer-readable program code encoded within the computer-useable medium, wherein the computer-readable program code comprises (a) a database comprising the nucleotide sequences disclosed herein; and (b) effects the following steps with a computer system (i) determining sequence similarity between one or more first nucleotide sequences as disclosed herein as compared to one or more second sequences; and (ii) displaying the sequence similarity between the first and second nucleotide sequences. Furthermore, in any these embodiments, the computer product can include or be operably linked to a user interface, for example to query the database, display information, etc.

Also provided is a computer program product comprising a computer-useable medium and computer-readable program code encoded within the computer-useable medium, wherein the computer-readable program code comprises (a) a database comprising the amino acid sequences disclosed herein; and (b) effects the following steps with a computer system (i) determining sequence similarity between one or more first amino acid sequences as disclosed herein as compared to one or more second amino acid sequences; and (ii) displaying the sequence similarity between the first and second amino acid sequences. Furthermore, in any these embodiments, the computer product can include or be operably linked to a user interface, for example to query the database, display information, etc.

Additional disclosure of computer systems and computer-readable storage media are provided in U.S. Pat. No. 6,528,289, for the purpose of describing exemplary computer systems and computer-readable media.

Plant Growth Promotion The compositions disclosed herein, in particular, *C. subtsugae* nucleic acids and polypeptides, can be used to modulate or more particularly promote growth of plants, e.g. crops such as fruit (e.g., strawberry), vegetables (e.g., tomato, squash, pepper, eggplant), grain crops (e.g., soy, wheat, rice, corn), trees, flowers, ornamental plants, shrubs (e.g., cotton, roses), bulb plants (e.g., onion, garlic) vines (e.g., grape vine), and turf (e.g. bermudagrass, Kentucky bluegrass, fescues). The compositions can also be used to modulate the germination of a seed(s) in a plant(s).

*C. subtsugae* nucleic acids and polypeptides, or a formulated product thereof, can be used alone or in combination with one or more other components as described below, such as growth promoting agents and/or anti-phytopathogenic agents in a tank mix or in a program (sequential application called rotation) with predetermined order and application interval during the growing season. When used in a combination with the above-mentioned products, at a concentration lower than recommended on the product label, the combined efficacy of the two or more products (one of which is the said composition disclosed herein) is, in certain embodiments, greater than the sum of each individual component's effect. Hence, the effect is enhanced by synergism between these two (or more) products, and the risk for the development of pesticide resistance among the plant pathogenic strains is reduced.

The composition can be applied by root dip at transplanting, specifically by treating a fruit or vegetable with the composition by dipping roots of the fruit or vegetable in a suspension of said composition (about 0.25 to about 1.5% and more particularly about 0.5% to about 1.0% by volume) prior to transplanting the fruit or vegetable into the soil.

Alternatively, the composition can be applied by drip or other irrigation system. Specifically, the composition can be injected into a drip irrigation system. In a particular embodiment, the composition is applied in a solution having a concentration of $1\times10^8$ CFU/mL at a rate of about 11 to about 4 quarts per acre.

In yet another embodiment, the composition can be added as an in-furrow application. Specifically, the composition can be added as an in-furrow spray at planting using nozzles calibrated to deliver a total output of 2-6 gallons/acre. Nozzles can be placed in the furrow opener on the planter so that the pesticide application and seed drop into the furrow are simultaneous.

Mixtures of the disclosed compositions with, for example, a solid or liquid adjuvant are prepared as known in the art. For example, mixtures can be prepared by homogeneously mixing and/or grinding the active ingredients with extenders such as solvents, solid carriers and, where appropriate, surface-active compounds (surfactants). The compositions can also contain additional ingredients such as stabilizers, viscosity regulators, binders, adjuvants as well as fertilizers or other active ingredients in order to obtain additional desired effects.

Combinations with Plant Growth Promoting Agents The compositions disclosed herein can be used in combination with other growth promoting agents such as synthetic or organic fertilizers (e.g., di-ammonium phosphate, in either granular or liquid form), compost teas, seaweed extracts, plant growth hormones such as IAA (indole acetic acid) used in a rooting hormone treatment for transplants either alone or in combination with plant growth regulators such as IBA (indole butyric acid) and NAA (naphthalene acetic acid), and growth promoting microbes, such as, for example, methylotrophs, PPFM (Pink Pigmented Facultative Methylotrphs), *Bacillus* spp., *Pseudomonads, Rhizobia,* and *Trichoderma.*

Seed Coating Agents The compositions disclosed herein can also be used in combination with seed-coating agents. Such seed coating agents include, but are not limited to, ethylene glycol, polyethylene glycol, chitosan, carboxymethyl chitosan, peat moss, resins and waxes or chemical fungicides or bactericides with either single site, multisite or unknown mode of action.

Anti-Phytopathogenic agents The compositions disclosed herein can also be used in combination with other anti-phytopathogenic agents, such as plant extracts, biopesticides, inorganic crop protectants (such as copper), surfactants (such as rhamnolipids; Gandhi et al., 2007) or natural oils such as paraffin oil and tea tree oil possessing pesticidal properties or chemical fungicides or bactericides with either single site, multisite or unknown mode of action. As defined herein, an "anti-phytopathogenic agent" is an agent that modulates the growth of a plant pathogen, particularly a pathogen causing soil-borne disease on a plant, or alternatively prevents infection of a plant by a plant pathogen. Plant pathogens include but are not limited to fungi, bacteria, actinomycetes and viruses.

An anti-phytopathogenic agent can be a single-site antifungal agent which can include but is not limited to benzimidazole, a demethylation inhibitor (DMI) (e.g., imidazole, piperazine, pyrimidine, triazole), morpholine, hydroxypyrimidine, anilinopyrimidine, phosphorothiolate, quinone outside inhibitor, quinoline, dicarboximide, carboximide, phenylamide, anilinopyrimidine, phenylpyrrole, aromatic hydrocarbon, cinnamic acid, hydroxyanilide, antibiotic, polyoxin, acylamine, phthalimide, benzenoid (xylylalanine). In a more particular embodiment, the antifungal agent is a demethylation inhibitor selected from the group consisting of imidazole, piperazine, pyrimidine and triazole (e.g., bitertanol, myclobutanil, penconazole, propiconazole, triadimefon, bromuconazole, cyproconazole, diniconazole, fenbuconazole, hexaconazole, tebuconazole, tetraconazole). In a most particular embodiment, the antifungal agent is myclobutanil. In yet another particular embodiment, the antifungal agent is a quinone outside inhibitor (e.g., strobilurin). The strobilurin may include but is not limited to azoxystrobin, kresoxim-methyl or trifloxystrobin. In yet another particular embodiment, the anti-fungal agent is a quinone, e.g., quinoxyfen (5,7-dichloro-4-quinolyl4-fluorophenyl ether).

In yet a further embodiment, the fungicide is a multi-site non-inorganic, chemical fungicide selected from the group consisting of chloronitrile, quinoxaline, sulphamide, phosphonate, phosphite, dithiocarbamate, chloralkythios, phenylpyridine-amine, and cyano-acetamide oxime.

In yet a further embodiment, the anti-phytopathogenic agent can be streptomycin, tetracycline, oxytetracycline, copper, or kasugamycin.

Bioremediation The *C. subtsugae* genome encodes genes involved in the metabolism of, inter alia, phosphorus, iron and aromatic compounds. See, e.g., Table 6 supra. Such genes and their gene products can be used in bioremediation methods. For instance, genes and sequences realted to metal tansport, metal accumulation, degradation of organic compounds, and other metabolite transformation can be engineered into plants with the purpose of applying the transformed plant to bioremediation of soils, sediment, water, and other polluted substrates. Protocols for the transformation of Indian mustard (*Brassica juncea*), sunflower (*Helianthus annus*), tomato and yellow poplar (*Liriodendron tulipifera*) are known. See, e.g., Eapen and D'Souza (2005); Mello-Farias and Chavez (2008).

Plants can be transformed with Cytochrome P450-encoding genes to increase their resistance to particular pollutants, both organic and inorganic. Transformation with nucleic acids encoding enzymes involved in gluthatione conjugation (for example, glutathione S-transferases) can increase rates of xenobiotic detoxification. Plants expressing bacterial nitroreductases can be used for the detoxification of nitrate organic compounds, such as explosives.

Uses of transgenic plants for phytoremediation applications has been described, for example, by Abhilash et al. (2009); Van Aken et al. (2010); Doty (2008) and Macek et al. (2008).

EXAMPLES

Example 1

Cell growth and DNA extraction *Chromobacterium subtsugae* PRAA-1 was grown in 200 ml LB broth in 1 L flasks at 26° C. with rotation at 150 rpm for 24-48 hours. Biomass was harvested from the culture by centrifugation.

Genomic DNA was extracted using the MoBio Power Microbial Maxi-DNA Extraction Kit (MoBio Cat No. 122223-25). DNA was eluted in 1.5 ml of elution buffer (included in kit). To assess DNA quality and quantity, a 10 uL aliquot was loaded into a 1.5% agarose gel and electrophoresis was conducted for 30 minutes at 100 V. DNA was visualized with a UV transilluminator using EZ-Vision loading dye. Over 100 ug of DNA were recovered.

Example 2

DNA sequence determination and assembly DNA sequences were determined using a HiSeq 2000 (Illumina, San Diego, Calif.), with sequence reads of 100 bp, pair ended, aiming for a minimum coverage of 40×. Final data consisted of two sets of paired-end samples in FASTQ format, providing approximately 200× coverage of the genome.

The four FASTAQ files were used for assembly. FASTAQ sequences were subjected to quality control using FASTQC, and the average distance between pairs was calculated by comparing the first 10,000 pairs from both sets with the initial assembled contigs using BWA. Li & Durbin (2009) *Bioinformatics* 25(14):1754-1760. TrimGalore (Babraham Bioinformatics, Cambridge, UK) was then used to generate two high-quality paired-end sets and four single-read files for those sequences whose partner read was below the quality threshold of at least 50 nucleotides after clipping on Q2.

Sequence reads were assembled using Ray assembler v2.0.0. Boisvert et al. (2010) *J Comput Biol.* 17(11):1519-1533. A titration of kmer sizes was performed with a kmer range of 19-63; resulting in successful assemblies at 19, 21, 31, 41, 47, 49 and 63. Further scaffolding was performed using SSPACE v1.1 using all available reads on the scaffolds produced by the Ray analysis. Boetzer et al. (2011) *Bioinformatics* 27(4):578-579. Gaps were connected using GapFiller, with a maximum iteration of twenty steps. Boetzer & Pirovano (2012) *Genome Biol.* 13(6):R56. The resulting scaffolds were mapped against the reference genome of *Chromobacterium violaceum* ATCC 12742, using CONTIGuator with an e value of 1e-10. Galardini et al. (2011) *Source Code Biol. Med.* 6:11.

To confirm contig and scaffold orders, the alignments were inspected manually using ACT. Carver et al. (2008) *Bioinformatics* 24(23):2672-2676. The original dataset was mapped back onto the *Chromobacterium subtsugae* sequence using BWA (Li & Durbin, supra) with a seed length of 19.

This process yielded a high quality genome of 4,690,330 bases with a total of 145,992 bases in contigs not matching the reference genome (*Chromobacterium violaceum*) and 4,264 undefined nucleotides (N's) in 42 gaps. Subsequent filling of the gaps in pseudocontigs closed 8 of the 42 gaps and extended the pseudocontigs to 4,704,820 bases where most gaps are single 'N' positions with only 2 gaps remaining in positions 2,153,178-2,153,283 (105 bases) and 2,474,439-2,474,486 (47 bases).

Example 3

Genome annotation Initial predictions were obtained using RAST. Meyer et al. (2008) *BMC Bioinformatics* 9:386. These predictions utilized pseudocontigs and contigs that were rejected by CONTIGuator. The analysis yielded 4,467 CDS predictions, 92 tRNA predictions, 26 rRNA genes and 91 putative missing genes.

Example 4

General features of the *Chromobacterium substsugae* genome The genome of *Chromobacterium subtsugae* is a circular DNA molecule of 4,705,004 bp. No extrachromosomal plasmids were discovered during genome analysis.

Using RAST, 4532 features were identified, out of which 4415 were coding sequences, as well as 117 RNA sequences. Using RAST, it was possible to assign 1980 features to functional subsystems (about 45% of total), out of which 104 were hypothetical. Features not assigned to subsystems accounted for 55% of the total (2435 features) with 1280 being hypothetical.

Comparison to the most closely related organism, *Chromobacterium violaceum,* indicated that *Chromobacterium subtsugae* posseses 174 functional features that are not shared with *Chromobacterium violaceum,* 181 features are present in *C. violaceum* that are not present in *C. substugae,* and both organisms had 2179 functional features in common. In comparison with all sequences in *C. violaceum,* 3398 *C. subtsugae* sequences were found to have over 50% similarity, 2518 sequences had more than 80% similarity, and 1369 sequences had more than 90% similarity.

Example 5

Codon usage in *C. subtsugae* Codon usage bias is an important parameter in the optimization of the expression of heterologous genes, and for regulating the expression of genes in a particular host. For example, a codon usage table can be used to direct the modification of a nucleotide sequence so that it includes codons more preferable to the host, yet encodes the same amino acid sequence, in order to maximize expression of one or more desired proteins or peptides.

Based on SEQ ID NO: 1, a codon usage table for *C. subtsugae* was generated using CUSP software (emboss.bioinformatics.nl/cgi-bin/emboss/cusp) and is shown in Table 15.

TABLE 15

*C. subtsugae* codon usage
#CdsCount: 18257
#Coding GC 65.96%
#1st letter GC 67.83%
#2nd letter GC 62.69%
#3rd letter GC 67.37%

| #Codon | AA | Fraction | Frequency | Number |
|---|---|---|---|---|
| GCA | A | 0.146 | 20.669 | 28518 |
| GCC | A | 0.332 | 46.936 | 64761 |
| GCG | A | 0.325 | 45.959 | 63412 |
| GCT | A | 0.197 | 27.880 | 38467 |
| TGC | C | 0.726 | 19.161 | 26437 |
| TGT | C | 0.274 | 7.235 | 9983 |
| GAC | D | 0.598 | 22.148 | 30559 |
| GAT | D | 0.402 | 14.859 | 20502 |
| GAA | E | 0.547 | 16.860 | 23263 |
| GAG | E | 0.453 | 13.952 | 19250 |
| TTC | F | 0.725 | 15.255 | 21048 |
| TTT | F | 0.275 | 5.772 | 7964 |
| GGA | G | 0.164 | 15.235 | 21020 |
| GGC | G | 0.555 | 51.502 | 71061 |
| GGG | G | 0.135 | 12.517 | 17270 |
| GGT | G | 0.146 | 13.541 | 18684 |
| CAC | H | 0.493 | 13.794 | 19033 |
| CAT | H | 0.507 | 14.169 | 19550 |
| ATA | I | 0.122 | 3.317 | 4577 |
| ATC | I | 0.679 | 18.451 | 25458 |
| ATT | I | 0.199 | 5.409 | 7463 |
| AAA | K | 0.345 | 8.220 | 11341 |
| AAG | K | 0.655 | 15.603 | 21528 |
| CTA | L | 0.080 | 5.873 | 8103 |
| CTC | L | 0.100 | 7.354 | 10147 |
| CTG | L | 0.578 | 42.678 | 58886 |
| CTT | L | 0.113 | 8.372 | 11551 |
| TTA | L | 0.026 | 1.884 | 2599 |
| TTG | L | 0.104 | 7.638 | 10539 |
| ATG | M | 1.000 | 13.457 | 18568 |

TABLE 15-continued

| *C. subtsugae* codon usage<br>#CdsCount: 18257<br>#Coding GC 65.96%<br>#1st letter GC 67.83%<br>#2nd letter GC 62.69%<br>#3rd letter GC 67.37% | | | | |
|---|---|---|---|---|
| #Codon | AA | Fraction | Frequency | Number |
| AAC | N | 0.620 | 11.782 | 16257 |
| AAT | N | 0.380 | 7.219 | 9960 |
| CCA | P | 0.222 | 18.360 | 25332 |
| CCC | P | 0.157 | 12.928 | 17837 |
| CCG | P | 0.444 | 36.649 | 50567 |
| CCT | P | 0.177 | 14.631 | 20187 |
| CAA | Q | 0.449 | 18.181 | 25085 |
| CAG | Q | 0.551 | 22.345 | 30831 |
| AGA | R | 0.048 | 6.454 | 8905 |
| AGG | R | 0.080 | 10.825 | 14936 |
| CGA | R | 0.167 | 22.617 | 31206 |
| CGC | R | 0.383 | 51.783 | 71448 |
| CGG | R | 0.237 | 32.054 | 44227 |
| CGT | R | 0.086 | 11.595 | 15998 |
| AGC | S | 0.305 | 20.807 | 28709 |
| AGT | S | 0.062 | 4.216 | 5817 |
| TCA | S | 0.122 | 8.315 | 11473 |
| TCC | S | 0.182 | 12.443 | 17168 |
| TCG | S | 0.242 | 16.564 | 22855 |
| TCT | S | 0.087 | 5.977 | 8247 |
| ACA | T | 0.158 | 7.185 | 9914 |
| ACC | T | 0.405 | 18.418 | 25413 |
| ACG | T | 0.323 | 14.686 | 20263 |
| ACT | T | 0.114 | 5.166 | 7128 |
| GTA | V | 0.076 | 3.252 | 4487 |
| GTC | V | 0.291 | 12.486 | 17228 |
| GTG | V | 0.453 | 19.419 | 26793 |
| GTT | V | 0.180 | 7.709 | 10637 |
| TGG | W | 1.000 | 24.015 | 33135 |
| TAC | Y | 0.663 | 8.606 | 11874 |
| TAT | Y | 0.337 | 4.380 | 6043 |
| TAA | * | 0.086 | 1.143 | 1577 |
| TAG | * | 0.112 | 1.481 | 2043 |
| TGA | * | 0.802 | 10.608 | 14637 |

Example 6

Identification of gene clusters related to polyketide synthesis and other secondary metabolite production Secondary metabolite production clusters were examined using the antiSMASH program (antismash.secondarymetabolites.org/). As shown in Table 16, several putative clusters were identified, as well as four NRPS clusters, one indole cluster, one terpenoid cluster, one bacteriocin cluster, and one butyrolactone cluster. The amino acid compositions of NRPS sequences were predicted using NRSPredictor2 (nrps.informatik.uni-tuebingen.de).

TABLE 16

| Cluster | Type | From | To |
|---|---|---|---|
| Cluster 1 | Putative | 129943 | 134127 |
| Cluster 2 | Putative | 290722 | 315490 |
| Cluster 3 | Putative | 323716 | 329226 |
| Cluster 4 | Putative | 371894 | 394333 |
| Cluster 5 | Putative | 885815 | 893212 |
| Cluster 6 | Nrps | 1566319 | 1628592 |
| Cluster 7 | Putative | 2210421 | 2228951 |
| Cluster 8 | Nrps | 2299432 | 2347915 |
| Cluster 9 | Putative | 2352275 | 2367119 |
| Cluster 10 | Putative | 2384147 | 2393105 |
| Cluster 11 | Nrps-tlpks | 2424775 | 2490818 |
| Cluster 12 | Bacteriocin | 2890220 | 2901104 |
| Cluster 13 | Putative | 2949745 | 2965040 |
| Cluster 14 | Putative | 3074586 | 3081909 |
| Cluster 15 | Terpene | 3170248 | 3191973 |
| Cluster 16 | Indole | 3534153 | 3557149 |
| Cluster 17 | Putative | 3667563 | 3693003 |
| Cluster 18 | Bacteriocin | 3801030 | 3811854 |
| Cluster 19 | Putative | 4148365 | 4165333 |
| Cluster 20 | Butyrolactone | 4208155 | 4218943 |
| Cluster 21 | Putative | 4254490 | 4291018 |
| Cluster 22 | Nrps | 4337664 | 4385597 |

Example 7

Construction of a cosmid library from *Chromobacterium subtsugae* PRAA-1 A cosmid library is constructed to screen for *C. subtsugae* genes with novel activities relating to agriculture, pest control, pharmaceutical application, etc. Genomic DNA is isolated from *Chromobacterium subtsugae* by growing the isolate in suitable liquid media, for example LB, nutrient broth, or YM broth. Genomic DNA is extracted and purified using a commercial kit, such as PureLink Genomic DNA (Life Technologies), UltraClean DNA extraction Kit (MoBio), or Quiagen DNEasy kits. Alternatively, freshly grown cells are pelleted by centrifugation and resuspended in TE buffer (100 mM Tris pH 8, 10 mM EDTA) with 2 mg/ml lysozyme for 30 minutes at 37° C. The suspension is then treated with Proteinase K and SDS to remove protein and lipids (100 ug/ml Proteinase K in 1% SDS, 50 mM EDTA and 1M urea) and incubated 55° C. for 10 minutes. Following extraction with phenol-chloroform-isoamyl alchohol (25:24:1), the aqueous phase is recovered and mixed with 0.6 volumes of isopropanol (molecular grade) to precipitate the DNA. DNA is pelleted by centrifugation, washed with 70% ethanol at least twice, and the clean pellet is dried and resuspended in 0.5× TE buffer.

The clean DNA is digested with Sau3AI (New England Biolabs, Beverly, Mass.), using 0.5 units of enzyme per ug of DNA at 37° C., in 100 ul of buffer according to the manufacturer's recommendations. The digestion reaction is sampled at regular time intervals to determine a time point that provides fragments in the 40 kb range.

The library is prepared using a commercially available vector ligation kit such as SuperCos1 Cosmid Vector Kit (Agilent Technologies) following the manufacturer's directions. The ligation mixture is into phage using a commercially available kit, such as Gigapack XL III (Agilent Technologies), following the manufacturer's directions. Phage are used to infect competent cells such as *E. coli* XL-1MR (Agilent Technologies).

The cosmid library is plated on LB agar or other suitable media, supplemented with 50 ug/ml kanamycin. Inoculated plates are incubated overnight (up to 18 hours) at 37° C. At least 1000 colonies are picked from the plates and transferred to duplicate 96-well plates loaded with LB or other suitable liquid media. Multi-well plates are incubated overnight with agitation. One set of plates is used for screening, and the duplicate is stored at −80° C. after addition of 25% glycerol.

Example 8

Screening of a cosmid library for clones encoding lepidopteran insecticide activity Cosmid-containing cells are grown overnight in 96-well plates and are assayed using a diet-overlay method in which a sample of cells, cell broth, cell supernatant or cell extract is deposited on the surface of a diet-loaded 96-well plate and allowed to dry. Lepidopteran eggs, neonates or larvae of target insect (e.g., *Heliothis virescens, Trichlopusia ni, Spodoptera exigua, Plutella xylostella, Manduca sexta,* etc.) are loaded into each well, and the plates are incubated for 5 to 7 days. Each well is then evaluate d for hatching, mortality, stunting, and lack of food consumption. Cosmid clones with insectidal activity (e.g., death, lack of hatching, reduced feeding) are identified.

Example 9

Screening of a cosmid library for clones encoding nematicide activity Cosmid-containing cells are grown overnight in 96-well plates and assayed using a 96-well motility test in which cells, cell broth, cell supernatant or cell extract is deposited into the wells, and freshly hatched nematode juveniles (J2s) are then introduced into the wells (e.g., *Meloidogyne hapla, Meloidogyne incognita, Globodera* sp., *Heterodera* sp. etc.). Following addition of nematodes, the plates are incubated for 2 to 5 days, and each well is then evaluated for nematode motility. Paralyzed or dead nematodes appear straight while live nematodes move and have a curved or curled shape. Extracts, cells, supernatant and/or broth from clones with nematicide activity are identified.

The assay can be modified to evaluate nematode egg hatching. In this case, the screening plates are loaded with the test substance (cells, cell broth, cell supernatant or cell extract), and then a known number of nematode eggs are added. Hatching is measured by counting juveniles after 2-3 days of incubation and comparing to an untreated control. Extracts, cells, supernatant and/or broth from clones that inhibit nematode egg hatching are identified.

Example 10

Screening of cosmid library for clones encoding algaecide activity Cosmid-containing cells are grown overnight in 96-well plates. Target algae (e.g., *Chlamydomonas reinhardtii, Pseudokirchenella subcapitata, Spyrogyra* sp., *Microcystis aurantiaca, Anabaena* sp., etc.) are grown in Erlenmeyer flasks under lights, and dispensed into 96-well plates. The test substance (cells, supernatants, whole cell broth or extracts) is deposited into the wells, optionally with the use of a robot. Loaded plates are incubated for 3 days under lights. Algaecide activity is evident by decrease in chlorophyll production. Plates can be scored visually, or by measuring chlorophyll fluorescence using a multi-well UV-visible spectrophotometer.

Example 11

Screening of cosmid library for acaricide activity Cosmid-containing cells are grown overnight in multiple 96-well plates to obtain the desired amount of test substance. The acaricide bioassay is performed on excised leaf disks that are treated with the cells; or with extracts, supernatant, or whole cell broth derived therefrom. Small excised plant leaves or leaf disks are treated by applying the test substance to the surface. After the test substance has dried, target pests are introduced onto the leaf and mortality is evaluated after a predestined period of time.

The type of plant used for the assay is selected according to the target pest. For instance, for two-spotted spider mite (*T. urticae*), female adults (from a synchronized colony) are introduced to excised kidney bean leaf that has been treated with the test solution. Mortality is determined 2-3 days after treatment.

For western flower thrips (*F. occidentalis*), 10-12 first instar larvae are introduced onto an excised kidney bean leaf that has been treated with the test substance, and mortality is evaluated after 2-3 days.

Example 12

Characterizations of active clones obtained from functional screens DNA is extracted from cosmid clones expressing activity in any of the screening assays described in examples 8-11, or in any other functional screening assay. DNA can be isolated with the use of a commercial kit (e.g., MoBio UltraClean, Qiagen DNAEasy, etc.) or by alkaline lysis as described by Maniatis et al. (1989). Restriction enzyme digestion and gel electrophoresis can be used to compare the DNA content of clones.

DNA fragments of interest are subcloned using art-recognized methods, optionally with the use of a commercial kit, e.g., pGEM-T Vector System (Promega, Madison, Wis.) and expressed, e.g., in *E. coli.* The subclones can be re-screened in the functional bioassay and the DNA fragment(s) associated with the detected activity (e.g., toxin production) can be identified.

Identified DNA fragment(s) can be sequenced and mapped on the *C. subtsugae* genome, and can be used for the design of probes, e.g., for screening the genomes of *C. subtsugae* and other organisms for toxin biosynthetic genes. Fragments identified in this way can also be expressed in a heterologous host, or used to transform a plant.

Example 13

Transformation of tomato (*Solunum lycopersicum*) with *Agrobacterium* The following procedure is adapted from Sharma, M. K. et al, 2009."A simple and efficient *Agrobacterium*-mediated procedure for transformation of tomato." Journal of Biosciences 34:423-433.

Media and solutions The composition of various media is described in Table 17. Media components, except agar, are combined according to Table 17 and adjusted to pH 5.8 using 1N KOH, before adding plant-tissue culture grade agar, Stock solutions of BAP (6-benzylmaino purine) and zeatin are prepared in dimethyl sulphoxide (DMSO). Antibiotic stock solutions are prepared in deionized water and filter-sterilized. *Agrobacterium* strain AGL1 is grown on YEM agar or broth containing 100 mg/I rifampicin and 50 mg/I kanamycin.

Preparation of *Agrobacterium Agrobacterium tumefaciens,* transformed with the gene or genes of interest, (e.g., any of the genes disclosed in any of Tables 2-13) is grown in YEM medium with rifampicin and kanamycin, in shaking culture for 72 h at 28° C. and 200 rpm. Cells are pelleted by centrifugation, washed and resuspended in WS medium. Bacterial density is determined by measuring $OD_{600}$ and the final cell concentration is adjusted to ~$10^8$ cells/ml by diluting with WS medium.

Plant transformation Middle pieces (0.7×1.0 cm) from 10-day cotyledons are collected by excising at the tip and base. The sections are pre-cultured for 48 hours at 28° C. on M1 medium, with the adaxias surface in direct contact with the medium.

Healthy explants are selected and incubated in *Agrobacterium* suspension for 30 minutes, with inversion every 10 minutes. Explants are blotted on sterile tissue paper and returned to M1 agar (50-80 explants per plate) for an additional 72 hours. The explants are then washed 4-5 times in WS medium, blotted on sterile tissue paper and transferred to SM containing 1 mg/L trans-zeatin for regeneration (20-25 explants per regeneration plate).

Regeneration plates are incubated at 28° C. under a 16/8 light/dark cycle. Regeneration is evidenced by development of a callus. Regenerated explants are selected and transferred to fresh SM medium every 15 days.

Regenerated shoots can be excised from the callus and transferred to RM medium.

Plantlets that are at least 2 inches in height and have strong roots are selected for transfer to pots. Planting substrate consists of potting soil mixed 1:1 with 1:1:1 vermiculite:perlite:sphagnum.

TABLE 17

| | M1 | M2 | WS | SM | RM |
|---|---|---|---|---|---|
| MS Salts (Murashige and Skoog, 1962) | 0.5x | 1x | 1x | 1x | 1x |
| Gamborg's B5 vitamins | 0.5x | 1x | 1x | 1x | 1x |
| Sucrose (g/L) | 15 | 30 | 30 | 30 | 30 |
| Agar (% w/v) | 0.8 | 0.8 | 0 | 0.8 | 0.8 |
| BAP (mg/L) | 0 | 2 | 0 | 0 | 0 |
| Kanamycin (mg/L) | 0 | 0 | 0 | 100 | 100 |
| Cefotaxime (mg/L) | 0 | 0 | 0 | 500 | 500 |

Example 14

Creation of Transgenic Soybean plants comprising an insecticidal gene from *Chromobacterium substugae* Mature glycine max seeds are surface sterilized with chlorine gas inside a bell jar under a fume hood. Seeds are kept in 100×20 mm Petri dishes with chlorine gas produced by pouring 100 ml of 4% sodium hypochlorite into a beaker and adding 5 ml of 12N hydrochloric acid. After sterilization, seeds are placed on germination medium (GM; MS basal salts with vitamins, 3% sucrose, 0.8% plant agar, and 1 mg/L BAP, optimized from regeneration experiment, pH 5.8). Murashige and Skoog, 1962. Seeds are germinated under fluorescent light or darkness at 24±1° C. for 5-7 days to compare transformation frequency.

The method described here is a modification of that described by Zhang et al. (1999) *Plant Cell, Tissue and Organ Culture* 56:37-46. Two cotyledonary explants are obtained by cutting a horizontal slice through the hypocotyl with a No. 11 surgical blade. The hypocotyl is subsequently removed and ten scratches are made at the surface of cotyledonary node regions. Explants are immersed for 30 min in a suspension of *A. tumefaciens* which has been engineered to comprise the gene of interest, e.g., a gene that encodes an insecticidal protein, or a protein that is involved in the synthesis of an insecticidal compound. See Tables 2-13 above for listings of exemplary genes of interest. Following immersion, ten explants are randomly placed on sterile filter paper placed on solid co-cultivation medium (CM; Gamborg's B5 basal salts with vitamins, 3% sucrose, 20 mM MES, 3.3 mM L-cysteine, 1 mM dithiothreitol, 0.1 mM acetosyringone, 0.8% plant agar, pH 5.4) (Gamborg et al., 1968) in 100×20 mm Petri dishes, and incubated at 24±1° C. for 5 days under dark conditions.

After 5 days of co-cultivation, explants are briefly washed in liquid shoot induction medium (SIM; Gamborg's B5 basal salts with vitamins, 3% sucrose, 3 mM MES, 1.67 mg/L BAP, 250 mg/L cefotaxime, pH 5.7) to remove excess *A. tumefaciens* on explants. Explants are then transferred to solidified SIM without PPT to stimulate shoot induction for the first 14 days, after which the explants are sub-cultured on fresh SIM containing 5 mg/L PPT for selection of transformed shoots. Organogenic shoots from the explants are trimmed and then transferred to shoot elongation medium (SEM; MS basal salts with vitamins, 3% sucrose, 3 mM MES, 0.5 mg/L giberellic acid, 50 mg/L asparagine, 1 mg/L zeatin, 0.1 mg/L indole-3-acetic acid, 250 mg/L cefotaxime, 50 mg/L vancomycin, 0.8% plant agar, 5 mg/L PPT, pH 5.7). Explants are transferred to new SEM medium every 14 days, and surviving shoots are planted on root induction medium (RIM; MS basal salts with vitamins, 3% sucrose, 1 mg/L naphthalene acetic acid, 0.8% plant agar, pH 5.7) and grown until roots develop. After acclimation, the transgenic plants are transplanted to potting soil and maintained in a greenhouse. Selection is carried out by PCR. See also Lee, et al. (2011) *J. of Korean Soc. Appl. Biol. Chem.* 54: 37-45.

Example 15

Efficacy of two identified proteins against Corn rootworm (*Diabrotica undecimpunctata*) CRW SEQ ID NO:8924 and SEQ ID NO:7904 proteins were enriched and partially resolved from each other using strong cation and strong anion exchange resins and by hydrophobic interaction chromatography. Protein concentration was estimated using the Invitrogen Quant-iT assay calibrated with BSA. Proteins were buffered to approximately pH 6 with 20 mM MES or pH 7.5 with tris-HCl and were adjusted to 1 mg/mL total protein prior to bioassay.

Proteins were matched to their amino acid sequences by peptide spectrum matching. Excised protein bands were digested into peptides with trypsin and analyzed by LC-MS using an Agilent 6540 mass spectrometer. Recorded spectra were matched using the x!Tandem, PeptideProphet, and ProteinProphet software packages.

Activity against Corn rootworm was tested on Diet Overlay Bioassays. The appropriate artificial insect diet was dispensed into each well of a standard 96 well plate and allowed to dry. Once the diet solidified, 100 uL of the treatment was pipetted into the appropriate number of wells and allowed to dry. A single 1st instar larva was delivered into each well of a 96 well plate. Mortality was scored at 3 days after treatment.

Two proteins (SEQ ID NO:8924 and SEQ ID NO:7904) were tested in duplicates (Exp1 and Exp2) for insecticidal activity against Corn rootworm (*Diabrotica undecimpunctata*) CRW. Mortality was scored 3 days post treatment in two independent experiments. Results are shown in Table 18.

TABLE 18

| Summary | % Mortality Exp1 | Exp2 |
|---|---|---|
| SEQ ID NO: 8924 | 90 | 58.33 |
| SEQ ID NO: 7904 | 100 | 33.33 |

The inventions described and claimed herein are not to be limited in scope by the specific aspects herein disclosed, since these aspects are intended to be illustrative. Any equivalent aspects are intended to be within the scope of the disclosure. Indeed, various modifications of the methods and compositions shown and described herein will be apparent to those skilled in the art from the foregoing description. Such modifications are also intended to fall within the scope of the appended claims. In the case of conflict, the present disclosure including definitions will control.

Table 19 illustrates the sequence by SEQ ID NO and the function associated with that sequence.

TABLE 19

| SEQ ID NO. | function |
|---|---|
| 2 | Zn-dependent protease with chaperone function |
| 3 | Vibriolysin, extracellular zinc protease (EC 3.4.24.25) @ Pseudolysin, extracellular zinc protease (EC 3.4.24.26) |
| 4 | ATP-dependent protease HslV (EC 3.4.25.—) |
| 5 | ATP-dependent hsl protease ATP-binding subunit HslU |
| 6 | Exported zinc metalloprotease YfgC precursor |
| 7 | protease, putative |
| 8 | ATP-dependent Clp protease proteolytic subunit (EC 3.4.21.92) |
| 9 | Zinc metalloprotease (EC 3.4.24.—) |
| 10 | FIG004556: membrane metalloprotease |
| 11 | FIG004556: membrane metalloprotease |
| 12 | Vibriolysin, extracellular zinc protease (EC 3.4.24.25) @ Pseudolysin, extracellular zinc protease (EC 3.4.24.26) |
| 13 | Periplasmic serine proteases (ClpP class) |
| 14 | Putative protease |
| 15 | probable protease |
| 16 | probable protease |
| 17 | HtrA protease/chaperone protein |
| 18 | putative extracellular serine protease |
| 19 | ATP-dependent protease HslVU (ClpYQ), peptidase subunit |
| 20 | LasA protease precursor |
| 21 | Putative stomatin/prohibitin-family membrane protease subunit aq_911 |
| 22 | ATP-dependent protease La (EC 3.4.21.53) Type I |
| 23 | ATP-dependent Clp protease ATP-binding subunit ClpX |
| 24 | ATP-dependent Clp protease proteolytic subunit (EC 3.4.21.92) |
| 25 | periplasmic tail-specific protease |
| 26 | Putative stomatin/prohibitin-family membrane protease subunit YbbK |
| 27 | Putative activity regulator of membrane protease YbbK |
| 28 | Tricorn protease homolog (EC 3.4.21.—) |
| 29 | Serine protease precursor MucD/AlgY associated with sigma factor RpoE |
| 30 | Carboxyl-terminal protease (EC 3.4.21.102) |
| 31 | Inactive homolog of metal-dependent proteases, putative molecular chaperone |
| 32 | probable protease precursor |
| 33 | Possible periplasmic aspartyl protease |
| 34 | ATP-DEPENDENT PROTEASE SUBUNIT |
| 35 | ATP-dependent Clp protease adaptor protein ClpS |
| 36 | ATP-dependent Clp protease ATP-binding subunit ClpA |
| 37 | FIG001454: Transglutaminase-like enzymes, putative cysteine proteases |
| 38 | caax amino terminal protease family |
| 39 | Putative protease ydgD (EC 3.4.21.—) |
| 40 | ClpXP protease specificity-enhancing factor/Stringent starvation protein B |
| 41 | FIG139552: Putative protease |
| 42 | Putative protease |
| 43 | zinc protease (EC: 3.4.99.—) |
| 44 | 5'-methylthioadenosine phosphorylase (EC 2.4.2.28)/putative esterase |
| 45 | Phosphoheptose isomerase |
| 46 | probable transcriptional regulator |
| 47 | INTEGRAL MEMBRANE PROTEIN (Rhomboid family) |
| 48 | hypothetical protein |
| 49 | hypothetical protein |
| 50 | hypothetical protein |
| 51 | Hypothetical Zinc-finger containing protein |
| 52 | hypothetical protein |
| 53 | Mu-like prophage FluMu protein gp37 |
| 54 | Bacteriophage tail sheath protein |
| 55 | Transaldolase (EC 2.2.1.2) |
| 56 | hypothetical protein |
| 57 | Phage tail/DNA circulation protein |
| 58 | FIG003269: Prophage tail protein |
| 59 | Prophage baseplate assembly protein V |
| 60 | Bacteriophage protein GP46 |

TABLE 19-continued

| SEQ ID NO. | function |
|---|---|
| 61 | Phage FluMu protein gp47 |
| 62 | FIG121501: Prophage tail protein |
| 63 | Prophage tail fiber protein |
| 64 | probable tail fiber assembly protein |
| 65 | probable bacteriophge tail fiber protein |
| 66 | Prophage tail fiber protein |
| 67 | Permease of the drug/metabolite transporter (DMT) superfamily |
| 68 | Ser-tRNA(Ala) deacylase; Gly-tRNA(Ala) deacylase |
| 69 | Acetyltransferase (EC 2.3.1.—) |
| 70 | hypothetical protein |
| 71 | Biosynthetic Aromatic amino acid aminotransferase alpha (EC 2.6.1.57) |
| 72 | hypothetical protein |
| 73 | Beta-lactamase (EC 3.5.2.6) |
| 74 | serine/threonine kinase |
| 75 | Histidine ammonia-lyase (EC 4.3.1.3) |
| 76 | Urocanate hydratase (EC 4.2.1.49) |
| 77 | Formiminoglutamase (EC 3.5.3.8) |
| 78 | Imidazolonepropionase (EC 3.5.2.7) |
| 79 | Histidine utilization repressor |
| 80 | hypothetical protein |
| 81 | Aldose 1-epimerase |
| 82 | hypothetical protein |
| 83 | Glutathione S-transferase (EC 2.5.1.18) |
| 84 | hypothetical protein |
| 85 | hypothetical protein |
| 86 | probable peptidase VC1983 |
| 87 | hypothetical protein |
| 88 | hypothetical protein |
| 89 | hypothetical protein |
| 90 | hypothetical protein |
| 91 | rarD protein, chloamphenicol sensitive |
| 92 | Indolepyruvate ferredoxin oxidoreductase, alpha and beta subunits |
| 93 | hypothetical protein |
| 94 | probable transcriptional regulator |
| 95 | Short-chain dehydrogenase/reductase SDR |
| 96 | G-nucleotide exchange factor SopE |
| 97 | Small-conductance mechanosensitive channel |
| 98 | NAD-dependent protein deacetylase of SIR2 family |
| 99 | hypothetical protein |
| 100 | Glutathione S-transferase (EC 2.5.1.18) |
| 101 | hypothetical protein |
| 102 | hypothetical protein |
| 103 | INTRACELLULAR PHB DEPOLYMERASE |
| 104 | hypothetical protein |
| 105 | hypothetical protein |
| 106 | hypothetical protein |
| 107 | hypothetical protein |
| 108 | hypothetical protein |
| 109 | hypothetical protein |
| 110 | hypothetical protein |
| 111 | FIG00636320: hypothetical protein |
| 112 | Alkaline phosphodiesterase I (EC 3.1.4.1)/Nucleotide pyrophosphatase (EC 3.6.1.9) |
| 113 | Glycine-rich cell wall structural protein precursor |
| 114 | protein of unknown function DUF1123 |
| 115 | hypothetical protein |
| 116 | Putative collagenase |
| 117 | hypothetical protein |
| 118 | N-acetylglucosamine-regulated outer membrane porin |
| 119 | Sugar ABC transporter, periplasmic sugar-binding protein |
| 120 | Chitobiose ABC transport system, permease protein 1 |
| 121 | probable ABC transporter sugar permease |
| 122 | Beta-hexosaminidase (EC 3.2.1.52) |
| 123 | N-Acetyl-D-glucosamine ABC transport system ATP-binding protein |
| 124 | methyl-accepting chemotaxis protein |
| 125 | hypothetical protein |
| 126 | Aerobic glycerol-3-phosphate dehydrogenase (EC 1.1.5.3) |
| 127 | Glycerol uptake facilitator protein |
| 128 | Glycerol kinase (EC 2.7.1.30) |
| 129 | Pyruvate kinase (EC 2.7.1.40) |
| 130 | hypothetical protein |
| 131 | Biphenyl-2,3-diol 1,2-dioxygenase (EC 1.13.11.39) |
| 132 | Putative cytoplasmic protein |
| 133 | Ethyl tert-butyl ether degradation EthD |
| 134 | hypothetical protein |
| 135 | putative PTS IIA-like nitrogen-regulatory protein PtsN |
| 136 | hypothetical protein |

TABLE 19-continued

| SEQ ID NO. | function |
|---|---|
| 137 | hypothetical protein |
| 138 | hypothetical protein |
| 139 | Hydroxymethylpyrimidine phosphate synthase ThiC |
| 140 | hypothetical protein |
| 141 | Protein-L-isoaspartate O-methyltransferase (EC 2.1.1.77) |
| 142 | Rhodanese-related sulfurtransferase |
| 143 | Uracil-DNA glycosylase, family 1 |
| 144 | Hemolysins and related proteins containing CBS domains |
| 145 | hypothetical protein |
| 146 | Muramoyltetrapeptide carboxypeptidase (EC 3.4.17.13) |
| 147 | Lipopolysaccharide heptosyltransferase 1 (EC 2.4.1.—) |
| 148 | 3-deoxy-D-manno-octulosonic-acid transferase (EC 2.—.—.—) |
| 149 | y4mC gene in pNGR234a homolog |
| 150 | hypothetical protein |
| 151 | hypothetical protein |
| 152 | ADA regulatory protein/Methylated-DNA--protein-cysteine methyltransferase (EC 2.1.1.63) |
| 153 | Permease of the drug/metabolite transporter (DMT) superfamily |
| 154 | Osmolarity sensory histidine kinase EnvZ |
| 155 | Two-component system response regulator OmpR |
| 156 | hypothetical protein |
| 157 | hypothetical protein |
| 158 | Quinone oxidoreductase (EC 1.6.5.5) |
| 159 | Putative esterase, FIGfam005057 |
| 160 | hypothetical protein |
| 161 | Organic hydroperoxide resistance transcriptional regulator |
| 162 | Organic hydroperoxide resistance protein |
| 163 | sensory box protein |
| 164 | Autolysis response regulater LytR |
| 165 | hypothetical protein |
| 166 | ATP-dependent DNA helicase UvrD/PcrA |
| 167 | hypothetical protein |
| 168 | 5-methyltetrahydrofolate--homocysteine methyltransferase (EC 2.1.1.13) |
| 169 | hypothetical protein |
| 170 | hypothetical protein |
| 171 | hypothetical protein |
| 172 | hypothetical protein |
| 173 | hypothetical protein |
| 174 | hypothetical protein |
| 175 | hypothetical protein |
| 176 | hypothetical protein |
| 177 | Uncharacterized glutathione S-transferase-like protein |
| 178 | O-methyltransferase |
| 179 | probable transcriptional regulator |
| 180 | hypothetical protein |
| 181 | Glycerol-3-phosphate regulon repressor, DeoR family |
| 182 | Aminobutyraldehyde dehydrogenase (EC 1.2.1.19) |
| 183 | probable acetyltransferase |
| 184 | Transcriptional regulator, GntR family domain |
| 185 | hypothetical protein |
| 186 | Benzoate transport protein |
| 187 | Xaa-Pro aminopeptidase (EC 3.4.11.9) |
| 188 | Transcriptional regulator, AraC family |
| 189 | hypothetical protein |
| 190 | 4-hydroxy-2-oxoglutarate aldolase (EC 4.1.3.16) @ 2-dehydro-3-deoxyphosphogluconate aldolase (EC 4.1.2.14) |
| 191 | Phosphogluconate dehydratase (EC 4.2.1.12) |
| 192 | Glucose-6-phosphate 1-dehydrogenase (EC 1.1.1.49) |
| 193 | 6-phosphogluconolactonase (EC 3.1.1.31), eukaryotic type |
| 194 | Glucokinase (EC 2.7.1.2) |
| 195 | Phosphogluconate repressor HexR, RpiR family |
| 196 | Glucose-6-phosphate isomerase (EC 5.3.1.9) |
| 197 | hypothetical protein |
| 198 | hypothetical protein |
| 199 | hypothetical protein |
| 200 | Thiamin-phosphate pyrophosphorylase (EC 2.5.1.3) |
| 201 | Phosphomethylpyrimidine kinase (EC 2.7.4.7) |
| 202 | Rubredoxin |
| 203 | hypothetical protein |
| 204 | Protoporphyrinogen IX oxidase, novel form, HemJ (EC 1.3.—.—) |
| 205 | hypothetical protein |
| 206 | COGs COG2954 |
| 207 | hypothetical protein |
| 208 | Glutamate-1-semialdehyde aminotransferase (EC 5.4.3.8) |
| 209 | hypothetical protein |
| 210 | hypothetical protein |

TABLE 19-continued

| SEQ ID NO. | function |
|---|---|
| 211 | hypothetical protein |
| 212 | COG0553: Superfamily II DNA/RNA helicases, SNF2 family |
| 213 | probable transmembrane protein |
| 214 | transcriptional regulator, LysR family |
| 215 | probable endonuclease |
| 216 | Pyridoxamine 5'-phosphate oxidase (EC 1.4.3.5) |
| 217 | Bacterial leucyl aminopeptidase (EC 3.4.11.10) |
| 218 | Phosphoenolpyruvate carboxylase (EC 4.1.1.31) |
| 219 | Porphobilinogen deaminase (EC 2.5.1.61) |
| 220 | hypothetical protein |
| 221 | Uroporphyrinogen-III synthase (EC 4.2.1.75) |
| 222 | Homolog of *E. coli* HemX protein |
| 223 | Homolog of *E. coli* HemY protein |
| 224 | hypothetical protein |
| 225 | Glycine cleavage system transcriptional activator GcvA |
| 226 | probable transport transmembrane protein |
| 227 | Transcriptional regulator, MarR family |
| 228 | pleD gene product |
| 229 | Isopenicillin N synthase |
| 230 | Serine acetyltransferase (EC 2.3.1.30) |
| 231 | FOG: TPR repeat, SEL1 subfamily |
| 232 | Zn-dependent hydrolases, including glyoxylases |
| 233 | probable transmembrane protein |
| 234 | Ammonium transporter |
| 235 | Frataxin homolog CyaY, facilitates iron supply for heme A synthesis or Fe—S cluster assembly |
| 236 | hypothetical protein |
| 237 | aminotransferase, class I and II |
| 238 | hypothetical protein |
| 239 | hypothetical protein |
| 240 | hypothetical protein |
| 241 | hypothetical protein |
| 242 | hypothetical protein |
| 243 | sulfite dehydrogenase - subunitB (EC: 1.8.2.1) |
| 244 | hypothetical protein |
| 245 | Phosphoribosylaminoimidazole carboxylase catalytic subunit (EC 4.1.1.21) |
| 246 | Phosphoribosylaminoimidazole carboxylase ATPase subunit (EC 4.1.1.21) |
| 247 | hypothetical protein |
| 248 | DNA alkylation repair enzyme |
| 249 | Phosphoribosylaminoimidazole-succinocarboxamide synthase (EC 6.3.2.6) |
| 250 | Ribosomal-protein-S5p-alanine acetyltransferase |
| 251 | Lysophospholipase (EC 3.1.1.5); Monoglyceride lipase (EC 3.1.1.23); putative |
| 252 | Glutathione S-transferase (EC 2.5.1.18) |
| 253 | Carbonic anhydrase (EC 4.2.1.1) |
| 254 | 2,4-dienoyl-CoA reductase [NADPH] (EC 1.3.1.34) |
| 255 | Methyltransferase |
| 256 | hypothetical protein |
| 257 | Transcriptional regulator, LysR family |
| 258 | 4-carboxymuconolactone decarboxylase family protein |
| 259 | poly (3-hydroxybutyrate) depolymerase |
| 260 | 2-keto-3-deoxy-D-arabino-heptulosonate-7-phosphate synthase I alpha (EC 2.5.1.54) |
| 261 | C4-type zinc finger protein, DksA/TraR family |
| 262 | Cytochrome c551/c552 |
| 263 | Integral membrane protein YggT, involved in response to extracytoplasmic stress (osmotic shock) |
| 264 | Pyrroline-5-carboxylate reductase (EC 1.5.1.2) |
| 265 | Hypothetical protein YggS, proline synthase co-transcribed bacterial homolog PROSC |
| 266 | Twitching motility protein PilT |
| 267 | Twitching motility protein PilT |
| 268 | probable response regulator |
| 269 | probable response regulator |
| 270 | 2'-5' RNA ligase |
| 271 | Molybdenum cofactor biosynthesis protein MoaE; Molybdopterin converting factor subunit 2 |
| 272 | molybdopterin-converting factor subunit 1 |
| 273 | hypothetical protein |
| 274 | Fructose-bisphosphate aldolase class II (EC 4.1.2.13) |
| 275 | Lysine exporter protein (LYSE/YGGA) |
| 276 | Phosphoglycerate kinase (EC 2.7.2.3) |
| 277 | hypothetical protein |
| 278 | NAD-dependent glyceraldehyde-3-phosphate dehydrogenase (EC 1.2.1.12) |
| 279 | Transketolase (EC 2.2.1.1) |
| 280 | hypothetical protein |
| 281 | possible transmembrane protein |
| 282 | Glycerol-3-phosphate regulon repressor, DeoR family |
| 283 | Alcohol dehydrogenase (EC 1.1.1.1) |

TABLE 19-continued

| SEQ ID NO. | function |
|---|---|
| 284 | Transcriptional regulator, AraC family |
| 285 | Aspartate racemase (EC 5.1.1.13) |
| 286 | hypothetical protein |
| 287 | Argininosuccinate lyase (EC 4.3.2.1) |
| 288 | periplasmic binding protein |
| 289 | Glutamate Aspartate transport ATP-binding protein GltL (TC 3.A.1.3.4) |
| 290 | Glutamate Aspartate transport system permease protein GltK (TC 3.A.1.3.4) |
| 291 | Glutamate Aspartate transport system permease protein GltJ (TC 3.A.1.3.4) |
| 292 | Glutamate Aspartate periplasmic binding protein precursor GltI (TC 3.A.1.3.4) |
| 293 | Dimethyladenosine transferase (EC 2.1.1.—) |
| 294 | probable multidrug resistance protein |
| 295 | Septum formation protein Maf |
| 296 | Cytoplasmic axial filament protein CafA and Ribonuclease G (EC 3.1.4.—) |
| 297 | TPR repeat containing exported protein; Putative periplasmic protein contains a protein prenylyltransferase domain |
| 298 | 18K peptidoglycan-associated outer membrane lipoprotein; Peptidoglycan-associated lipoprotein precursor; Outer membrane protein P6; OmpA/MotB precursor |
| 299 | tolB protein precursor, periplasmic protein involved in the tonb-independent uptake of group A colicins |
| 300 | Putative TolA protein |
| 301 | Tol biopolymer transport system, TolR protein |
| 302 | probable O-methyltransferase |
| 303 | hypothetical protein |
| 304 | Integral membrane protein |
| 305 | probable two-component system sensor protein |
| 306 | ABC-type amino acid transport/signal transduction systems, periplasmic component/domain |
| 307 | NAD(P) transhydrogenase alpha subunit (EC 1.6.1.2) |
| 308 | NAD(P) transhydrogenase subunit beta (EC 1.6.1.2) |
| 309 | hypothetical protein |
| 310 | putative lipoprotein |
| 311 | SAM-dependent methyltransferases |
| 312 | hypothetical protein |
| 313 | Methyl-accepting chemotaxis protein |
| 314 | hypothetical protein |
| 315 | Long-chain-fatty-acid--CoA ligase (EC 6.2.1.3) |
| 316 | Long-chain-fatty-acid--CoA ligase (EC 6.2.1.3) |
| 317 | hypothetical protein |
| 318 | Exoribonuclease II (EC 3.1.13.1) |
| 319 | probable two-component response regulator |
| 320 | Putative exported protein precursor |
| 321 | hypothetical protein |
| 322 | probable methylated-DNA-[protein]-cysteine S-methyltransferase (EC: 2.1.1.63) |
| 323 | Hypothetical metal-binding enzyme, YcbL homolog |
| 324 | Fe—S OXIDOREDUCTASE (1.8.—.—) |
| 325 | Possible carboxymuconolactone decarboxylase family protein (EC 4.1.1.44) |
| 326 | Transcriptional regulator, ArsR family |
| 327 | Probable transmembrane protein |
| 328 | GENE II AND X PROTEINS |
| 329 | Cytochrome c4 |
| 330 | Peptide chain release factor 1 |
| 331 | Glutamyl-tRNA reductase (EC 1.2.1.70) |
| 332 | hypothetical protein |
| 333 | TonB-dependent receptor |
| 334 | ElaA |
| 335 | Topoisomerase IV subunit A (EC 5.99.1.—) |
| 336 | Signal transduction histidine kinase |
| 337 | Type IV fimbriae expression regulatory protein PilR |
| 338 | hypothetical protein |
| 339 | hypothetical protein |
| 340 | acyltransferase family protein |
| 341 | Glycosyltransferase of family GT2; modular; contains a TPR-repeat domain |
| 342 | Glycosyl transferase, group 2 family protein |
| 343 | COG3958: Transketolase, C-terminal subunit |
| 344 | Transketolase, N-terminal section (EC 2.2.1.1) |
| 345 | asparagine synthase (glutamine-hydrolyzing) (EC: 6.3.5.4) |
| 346 | hypothetical protein |
| 347 | hypothetical protein |
| 348 | HlyD family secretion protein |
| 349 | probable colicin V secretion atp-binding protein |
| 350 | transcriptional regulator, LysR family |
| 351 | hypothetical protein |
| 352 | 3-oxoacyl-[acyl-carrier protein] reductase (EC 1.1.1.100) |
| 353 | reductase |
| 354 | hypothetical protein |
| 355 | ribosomal protein S6 modification protein |

TABLE 19-continued

| SEQ ID NO. | function |
|---|---|
| 356 | hypothetical protein |
| 357 | FIG01132028: hypothetical protein |
| 358 | N-acetyl-gamma-glutamyl-phosphate reductase (EC 1.2.1.38) |
| 359 | N-acetyl-lysine deacetylase (EC 3.5.1.—) |
| 360 | Transketolase, N-terminal section (EC 2.2.1.1) |
| 361 | Transketolase, C-terminal section (EC 2.2.1.1) |
| 362 | Putative ligase/carboxylase protein |
| 363 | hypothetical protein |
| 364 | hypothetical protein |
| 365 | hypothetical protein |
| 366 | hypothetical protein |
| 367 | methyl-accepting chemotaxis protein II |
| 368 | regulatory protein, LysR:LysR, substrate-binding |
| 369 | hypothetical protein |
| 370 | Transcriptional regulator, TetR family |
| 371 | hypothetical protein |
| 372 | hypothetical protein |
| 373 | hypothetical protein |
| 374 | hypothetical protein |
| 375 | probable transport transmembrane protein |
| 376 | 3-oxoacyl-[acyl-carrier protein] reductase (EC 1.1.1.100) |
| 377 | hypothetical protein |
| 378 | hypothetical protein |
| 379 | RND efflux system, membrane fusion protein CmeA |
| 380 | RND efflux system, inner membrane transporter CmeB |
| 381 | hypothetical protein |
| 382 | probable thermolabile hemolysin |
| 383 | Methyltransferase (EC 2.1.1.—) |
| 384 | Phospholipase/lecithinase/hemolysin |
| 385 | Arsenic efflux pump protein |
| 386 | Inositol-1-monophosphatase (EC 3.1.3.25) |
| 387 | Ribosomal RNA small subunit methyltransferase E (EC 2.1.1.—) |
| 388 | hypothetical protein |
| 389 | hypothetical protein |
| 390 | Aspartate carbamoyltransferase (EC 2.1.3.2) |
| 391 | Aspartate carbamoyltransferase regulatory chain (Pyrl) |
| 392 | Chloride channel protein |
| 393 | GCN5-related N-acetyltransferase |
| 394 | Maebl |
| 395 | hypothetical protein |
| 396 | hypothetical protein |
| 397 | hypothetical protein |
| 398 | hypothetical protein |
| 399 | hypothetical protein |
| 400 | COG1451: Predicted metal-dependent hydrolase |
| 401 | YaeQ protein |
| 402 | hypothetical protein |
| 403 | ATP-dependent RNA helicase RhIE |
| 404 | hypothetical protein |
| 405 | Transcriptional regulator, TetR family |
| 406 | hypothetical protein |
| 407 | hypothetical protein |
| 408 | Ribosomal small subunit pseudouridine synthase A (EC 4.2.1.70) |
| 409 | NAD(P)H oxidoreductase YRKL (EC 1.6.99.—) @ Putative NADPH-quinone reductase (modulator of drug activity B) @ Flavodoxin 2 |
| 410 | Transcriptional regulator |
| 411 | FIG00506745: hypothetical protein |
| 412 | Aldehyde dehydrogenase B (EC 1.2.1.22) |
| 413 | probable methyltransferase protein |
| 414 | methyl-accepting chemotaxis protein |
| 415 | aerotaxis receptor |
| 416 | hypothetical protein |
| 417 | Biopolymer transport protein ExbD/TolR |
| 418 | MotA/TolQ/ExbB proton channel family protein |
| 419 | hypothetical protein |
| 420 | Ferric siderophore transport system, periplasmic binding protein TonB |
| 421 | COG0477: Permeases of the major facilitator superfamily |
| 422 | Small Subunit Ribosomal RNA; ssuRNA; SSU rRNA |
| 423 | tRNA-Ile-GAT |
| 424 | tRNA-Ala-TGC |
| 425 | Large Subunit Ribosomal RNA; lsuRNA; LSU rRNA |
| 426 | 5S RNA |
| 427 | Transcriptional regulator, TetR family |
| 428 | GCN5-related N-acetyltransferase |
| 429 | hypothetical protein |
| 430 | hypothetical protein |

TABLE 19-continued

| SEQ ID NO. | function |
|---|---|
| 431 | Cupin 2, conserved barrel domain protein |
| 432 | probable transmembrane efflux protein |
| 433 | dehydrogenase (secreted protein) |
| 434 | flavin reductase-like, FMN-binding |
| 435 | Acyltransferase 3 |
| 436 | Membrane fusion protein of RND family multidrug efflux pump |
| 437 | RND efflux system, inner membrane transporter CmeB |
| 438 | RND efflux system, outer membrane lipoprotein CmeC |
| 439 | Large Subunit Ribosomal RNA; lsuRNA; LSU rRNA |
| 440 | 5S RNA |
| 441 | Branched-chain amino acid ABC transporter, amino acid-binding protein (TC 3.A.1.4.1) |
| 442 | RND efflux system, outer membrane lipoprotein CmeC |
| 443 | RND efflux system, inner membrane transporter CmeB |
| 444 | RND efflux system, membrane fusion protein CmeA |
| 445 | Transcription repressor of multidrug efflux pump acrAB operon, TetR (AcrR) family |
| 446 | probable ABC transporter ATP-binding protein |
| 447 | ABC-type multidrug transport system, permease component |
| 448 | YrbA protein |
| 449 | UDP-N-acetylglucosamine 1-carboxyvinyltransferase (EC 2.5.1.7) |
| 450 | Alkylphosphonate utilization operon protein PhnA |
| 451 | Surface lipoprotein |
| 452 | hypothetical protein |
| 453 | Uncharacterized ABC transporter, auxiliary component YrbC |
| 454 | Uncharacterized ABC transporter, periplasmic component YrbD |
| 455 | Uncharacterized ABC transporter, permease component YrbE |
| 456 | Uncharacterized ABC transporter, ATP-binding protein YrbF |
| 457 | 2,3,4,5-tetrahydropyridine-2,6-dicarboxylate N-succinyltransferase (EC 2.3.1.117) |
| 458 | N-succinyl-L,L-diaminopimelate aminotransferase alternative (EC 2.6.1.17) |
| 459 | Permeases of the drug/metabolite transporter (DMT) superfamily |
| 460 | Histone acetyltransferase HPA2 and related acetyltransferases |
| 461 | hypothetical protein |
| 462 | hypothetical protein |
| 463 | hypothetical protein |
| 464 | hypothetical protein |
| 465 | Histidine permease YuiF |
| 466 | hypothetical protein |
| 467 | hypothetical protein |
| 468 | hypothetical protein |
| 469 | Transcriptional regulator, ArsR family |
| 470 | putative orphan protein |
| 471 | putative cytochrome p450 oxidoreductase |
| 472 | Antibiotic biosynthesis monooxygenase |
| 473 | SAM-dependent methyltransferase (EC 2.1.1.—) |
| 474 | Fibronectin type III domain protein |
| 475 | hypothetical protein |
| 476 | Outer membrane protein |
| 477 | Probable RND efflux membrane fusion protein |
| 478 | Membrane-fusion protein |
| 479 | Peptidase M50 |
| 480 | Acetyltransferase, GNAT family (EC 2.3.1.—) |
| 481 | hypothetical protein |
| 482 | Microcystin dependent protein |
| 483 | competence protein |
| 484 | probable two-component response regulator |
| 485 | hypothetical protein |
| 486 | Cobyrinic acid a,c-diamide synthase |
| 487 | FIG00506450: hypothetical protein |
| 488 | hypothetical protein |
| 489 | ATP-dependent DNA helicase RecQ |
| 490 | Glutamate N-acetyltransferase (EC 2.3.1.35)/N-acetylglutamate synthase (EC 2.3.1.1) |
| 491 | Transposase and inactivated derivatives |
| 492 | Dihydrolipoamide dehydrogenase of pyruvate dehydrogenase complex (EC 1.8.1.4) |
| 493 | Dihydrolipoamide acetyltransferase component of pyruvate dehydrogenase complex (EC 2.3.1.12) |
| 494 | Pyruvate dehydrogenase E1 component (EC 1.2.4.1) |
| 495 | hypothetical protein |
| 496 | membrane protein, putative |
| 497 | Cell division protein DivIC (FtsB), stabilizes FtsL against RasP cleavage |
| 498 | hypothetical protein |
| 499 | Carbonic anhydrase (EC 4.2.1.1) |
| 500 | Nicotinate-nucleotide adenylyltransferase (EC 2.7.7.18) |
| 501 | lojap protein |
| 502 | LSU m3Psi1915 methyltransferase RlmH |
| 503 | hypothetical protein |
| 504 | Permeases of the major facilitator superfamily |
| 505 | hypothetical protein |

TABLE 19-continued

| SEQ ID NO. | function |
|---|---|
| 506 | Transcriptional regulator, LysR family |
| 507 | probable MFS transporter |
| 508 | DNA polymerase III delta subunit (EC 2.7.7.7) |
| 509 | LPS-assembly lipoprotein RlpB precursor (Rare lipoprotein B) |
| 510 | Leucyl-tRNA synthetase (EC 6.1.1.4) |
| 511 | Protein of unknown function DUF81 |
| 512 | Protein of unknown function DUF55 |
| 513 | hypothetical protein |
| 514 | hypothetical protein |
| 515 | 5-formyltetrahydrofolate cyclo-ligase (EC 6.3.3.2) |
| 516 | FIG017670: hypothetical protein |
| 517 | hypothetical protein |
| 518 | Vitamin B12 ABC transporter, B12-binding component BtuF |
| 519 | Adenosylcobinamide-phosphate guanylyltransferase (EC 2.7.7.62) |
| 520 | TonB-dependent receptor |
| 521 | Nicotinate-nucleotide--dimethylbenzimidazole phosphoribosyltransferase (EC 2.4.2.21) |
| 522 | Alpha-ribazole-5'-phosphate phosphatase (EC 3.1.3.73) |
| 523 | Cobalamin synthase |
| 524 | hypothetical protein |
| 525 | Probable transmembrane protein |
| 526 | hypothetical protein |
| 527 | Pantothenate kinase type III, CoaX-like (EC 2.7.1.33) |
| 528 | Biotin-protein ligase (EC 6.3.4.15)/Biotin operon repressor |
| 529 | Glycerol-3-phosphate cytidylyltransferase (EC 2.7.7.39) |
| 530 | Type IV fimbrial biogenesis protein FimT |
| 531 | Type IV pilus biogenesis protein PilE |
| 532 | Type IV fimbrial biogenesis protein PilY1 |
| 533 | Type IV fimbrial biogenesis protein PilX |
| 534 | Type IV fimbrial biogenesis protein PilW |
| 535 | Type IV fimbrial biogenesis protein PilV |
| 536 | 5S RNA |
| 537 | Mobile element protein |
| 538 | hypothetical protein |
| 539 | major facilitator superfamily MFS_1 |
| 540 | Transcriptional regulator, LysR family |
| 541 | hypothetical protein |
| 542 | hypothetical protein |
| 543 | hypothetical protein |
| 544 | Transcriptional regulator, LysR family |
| 545 | MFS transporter |
| 546 | Cyanate hydratase (EC 4.2.1.104) |
| 547 | Carbonic anhydrase (EC 4.2.1.1) |
| 548 | Cyn operon transcriptional activator |
| 549 | hypothetical protein |
| 550 | Bifunctional protein: zinc-containing alcohol dehydrogenase; quinone oxidoreductase (NADPH:quinone reductase) (EC 1.1.1.—); Similar to arginate lyase |
| 551 | Transcriptional regulator, LysR family |
| 552 | Fe(2+)/alpha-ketoglutarate-dependent dioxygenase LpxO |
| 553 | hypothetical protein |
| 554 | 3',5'-cyclic-nucleotide phosphodiesterase (EC 3.1.4.17) |
| 555 | Putative preQ0 transporter |
| 556 | hypothetical protein |
| 557 | hypothetical protein |
| 558 | Multimodular transpeptidase-transglycosylase (EC 2.4.1.129) (EC 3.4.—.—) |
| 559 | Type IV pilus biogenesis protein PilM |
| 560 | Type IV pilus biogenesis protein PilN |
| 561 | Type IV pilus biogenesis protein PilO |
| 562 | Type IV pilus biogenesis protein PilP |
| 563 | Type IV pilus biogenesis protein PilQ |
| 564 | Shikimate kinase I (EC 2.7.1.71) |
| 565 | 3-dehydroquinate synthase (EC 4.2.3.4) |
| 566 | hypothetical protein |
| 567 | hypothetical protein |
| 568 | LgtG |
| 569 | Putative two-domain glycosyltransferase |
| 570 | Beta 1,4 glucosyltransferase |
| 571 | Lipid A export ATP-binding/permease protein MsbA (EC 3.6.3.25) |
| 572 | Lipopolysaccharide heptosyltransferase III (EC 2.4.1.—) |
| 573 | Phosphoenolpyruvate-protein phosphotransferase of PTS system (EC 2.7.3.9) |
| 574 | Phosphocarrier protein, nitrogen regulation associated |
| 575 | PTS system fructose subfamily IIA component |
| 576 | Siroheme synthase/Precorrin-2 oxidase (EC 1.3.1.76)/Sirohydrochlorin ferrochelatase (EC 4.99.1.4)/Uroporphyrinogen-III methyltransferase (EC 2.1.1.107) |
| 577 | hypothetical protein |
| 578 | hypothetical protein |
| 579 | probable putative transmembrane protein |

TABLE 19-continued

| SEQ ID NO. | function |
|---|---|
| 580 | Ribonuclease BN (EC 3.1.—.—) |
| 581 | Trp repressor-binding protein |
| 582 | Transcriptional regulator, AraC family |
| 583 | Fosmidomycin resistance protein |
| 584 | Periplasmic protein p19 involved in high-affinity Fe2+ transport |
| 585 | putative exported protein |
| 586 | High-affinity iron permease |
| 587 | Ferredoxin |
| 588 | probable ABC transporter, periplasmic binding protein |
| 589 | Transcriptional regulator |
| 590 | FIG001196: Membrane protein YedZ |
| 591 | Putative sulfite oxidase subunit YedY |
| 592 | hypothetical protein |
| 593 | hypothetical protein |
| 594 | hypothetical protein |
| 595 | Homoserine O-acetyltransferase (EC 2.3.1.31) |
| 596 | Methionine biosynthesis protein MetW |
| 597 | putative membrane protein |
| 598 | AmpG permease |
| 599 | Type IV pilus biogenesis protein PilE |
| 600 | hypothetical protein |
| 601 | hypothetical protein |
| 602 | hypothetical protein |
| 603 | DNA polymerase I (EC 2.7.7.7) |
| 604 | FIG00857679: hypothetical protein |
| 605 | hypothetical protein |
| 606 | Homoserine kinase (EC 2.7.1.39) |
| 607 | hypothetical protein |
| 608 | hypothetical protein |
| 609 | capsule polysaccharide export system periplasmic protein |
| 610 | Tyrosine-protein kinase Wzc (EC 2.7.10.2) |
| 611 | Inner membrane component of tripartite multidrug resistance system |
| 612 | Arsenate reductase (EC 1.20.4.1) |
| 613 | Transcription repressor |
| 614 | Outer membrane component of tripartite multidrug resistance system |
| 615 | Membrane fusion component of tripartite multidrug resistance system |
| 616 | Inner membrane component of tripartite multidrug resistance system |
| 617 | LysR family transcriptional regulator YeiE |
| 618 | Putative membrane protein YeiH |
| 619 | hypothetical protein |
| 620 | COG2879, Hypothetical small protein yjiX |
| 621 | Carbon starvation protein A paralog |
| 622 | Transcriptional regulatory protein RstA |
| 623 | Sensory histidine kinase in two-component regulatory system with RstA |
| 624 | probable carboxylesterase |
| 625 | hypothetical protein |
| 626 | Coproporphyrinogen III oxidase, aerobic (EC 1.3.3.3) |
| 627 | Polymyxin resistance protein ArnT, undecaprenyl phosphate-alpha-L-Ara4N transferase; Melittin resistance protein PqaB |
| 628 | Permease of the drug/metabolite transporter (DMT) superfamily |
| 629 | UDP-4-amino-4-deoxy-L-arabinose--oxoglutarate aminotransferase (EC 2.6.1.—) |
| 630 | Polymyxin resistance protein ArnC, glycosyl transferase (EC 2.4.—.—) |
| 631 | Polymyxin resistance protein ArnA_FT, UDP-4-amino-4-deoxy-L-arabinose formylase (EC 2.1.2.—) |
| 632 | Polymyxin resistance protein ArnA_DH, UDP-glucuronic acid decarboxylase (EC 4.1.1.—) |
| 633 | hypothetical protein |
| 634 | Polymyxin resistance protein PmrJ, predicted deacetylase |
| 635 | hypothetical protein |
| 636 | hypothetical protein |
| 637 | hypothetical protein |
| 638 | Transcriptional regulator, LysR family, in formaldehyde detoxification operon |
| 639 | S-(hydroxymethyl)glutathione dehydrogenase (EC 1.1.1.284) |
| 640 | S-formylglutathione hydrolase (EC 3.1.2.12) |
| 641 | tRNA-Tyr-GTA |
| 642 | cAMP-binding proteins - catabolite gene activator and regulatory subunit of cAMP-dependent protein kinases |
| 643 | DNA-directed RNA polymerase specialized sigma subunit, sigma24-like |
| 644 | hypothetical protein |
| 645 | hypothetical protein |
| 646 | hypothetical protein |
| 647 | probable RebB like protein |
| 648 | hypothetical protein |
| 649 | hypothetical protein |
| 650 | poly (3-hydroxybutyrate) depolymerase |
| 651 | hypothetical protein |
| 652 | probable phage-related lysozyme (EC: 3.2.1.17) |

TABLE 19-continued

| SEQ ID NO. | function |
|---|---|
| 653 | hypothetical protein |
| 654 | Methyl-accepting chemotaxis protein |
| 655 | probable RebB like protein |
| 656 | probable RebB like protein |
| 657 | probable RebB like protein |
| 658 | probable RebB like protein |
| 659 | Transcriptional regulator, LysR family |
| 660 | major facilitator superfamily MFS_1 |
| 661 | hypothetical protein |
| 662 | probable transcriptional regulator |
| 663 | Transcriptional regulator, LysR family |
| 664 | Rrf2-linked NADH-flavin reductase |
| 665 | putative cytoplasmic protein |
| 666 | Major facilitator superfamily |
| 667 | HTH-type transcriptional regulator PtxR |
| 668 | Methyl-accepting chemotaxis protein |
| 669 | hypothetical protein |
| 670 | Transcriptional regulator, TetR family |
| 671 | Outer membrane component of tripartite multidrug resistance system |
| 672 | Membrane fusion component of tripartite multidrug resistance system |
| 673 | Inner membrane component of tripartite multidrug resistance system |
| 674 | hypothetical protein |
| 675 | hypothetical protein |
| 676 | hypothetical protein |
| 677 | FKBP-type peptidyl-prolyl cis-trans isomerase |
| 678 | Methylglyoxal reductase, acetol producing (EC 1.1.1.—)/2,5-diketo-D-gluconic acid reductase B (EC 1.1.1.274) |
| 679 | Putative drug efflux protein |
| 680 | Transcriptional regulator, LysR family |
| 681 | hypothetical protein |
| 682 | hypothetical protein |
| 683 | hypothetical protein |
| 684 | D-beta-hydroxybutyrate dehydrogenase (EC 1.1.1.30) |
| 685 | Ferredoxin reductase |
| 686 | Oxidoreductase |
| 687 | Transcriptional regulator, AraC family |
| 688 | FKBP-type peptidyl-prolyl cis-trans isomerase SlyD (EC 5.2.1.8) |
| 689 | Transcriptional regulator, LysR family |
| 690 | short chain dehydrogenase (EC: 1.—) |
| 691 | Alcohol dehydrogenase (EC 1.1.1.1) |
| 692 | hypothetical protein |
| 693 | Glucosamine--fructose-6-phosphate aminotransferase [isomerizing] (EC 2.6.1.16) |
| 694 | Transcriptional regulator of glmS gene, DeoR family |
| 695 | N-acetylglucosamine-1-phosphate uridyltransferase (EC 2.7.7.23)/Glucosamine-1-phosphate N-acetyltransferase (EC 2.3.1.157) |
| 696 | ATP synthase epsilon chain (EC 3.6.3.14) |
| 697 | ATP synthase beta chain (EC 3.6.3.14) |
| 698 | ATP synthase gamma chain (EC 3.6.3.14) |
| 699 | ATP synthase alpha chain (EC 3.6.3.14) |
| 700 | ATP synthase delta chain (EC 3.6.3.14) |
| 701 | ATP synthase B chain (EC 3.6.3.14) |
| 702 | ATP synthase C chain (EC 3.6.3.14) |
| 703 | ATP synthase A chain (EC 3.6.3.14) |
| 704 | hypothetical protein |
| 705 | Chromosome (plasmid) partitioning protein ParB/Stage 0 sporulation protein J |
| 706 | Chromosome (plasmid) partitioning protein ParA/Sporulation initiation inhibitor protein Soj |
| 707 | rRNA small subunit 7-methylguanosine (m7G) methyltransferase GidB |
| 708 | tRNA uridine 5-carboxymethylaminomethyl modification enzyme GidA |
| 709 | Putative hemolysin |
| 710 | COG1720: Uncharacterized conserved protein |
| 711 | putative membrane protein |
| 712 | EAL domain protein |
| 713 | hypothetical protein |
| 714 | 21 kDa hemolysin precursor |
| 715 | Phosphoheptose isomerase (EC 5.3.1.—) |
| 716 | Predicted endonuclease distantly related to archaeal Holliday junction resolvase |
| 717 | LppC putative lipoprotein |
| 718 | rRNA small subunit methyltransferase I |
| 719 | tRNA-Leu-CAA |
| 720 | prophage CP4-like integrase |
| 721 | Prophage CP4-57 regulatory |
| 722 | hypothetical protein |
| 723 | Phage major capsid protein |
| 724 | hypothetical protein |
| 725 | hypothetical protein |

TABLE 19-continued

| SEQ ID NO. | function |
|---|---|
| 726 | hypothetical protein |
| 727 | hypothetical protein |
| 728 | conserved hypothetical protein |
| 729 | hypothetical protein |
| 730 | hypothetical protein |
| 731 | hypothetical protein |
| 732 | Adenosine deaminase (EC 3.5.4.4) |
| 733 | hypothetical protein |
| 734 | NADH ubiquinone oxidoreductase chain A (EC 1.6.5.3) |
| 735 | Mg/Co/Ni transporter MgtE/CBS domain |
| 736 | hypothetical protein |
| 737 | probable transmembrane protein |
| 738 | Chloride channel protein |
| 739 | Transcriptional regulator, MarR family |
| 740 | Probable transmembrane protein |
| 741 | hypothetical protein |
| 742 | ABC superfamily (ATP-binding membrane) transport protein |
| 743 | MutT domain containing protein |
| 744 | hypothetical protein |
| 745 | Putative deoxyribonuclease YjjV |
| 746 | methyl-accepting chemotaxis protein IV |
| 747 | Probable transmembrane protein |
| 748 | Twin-arginine translocation protein TatC |
| 749 | Twin-arginine translocation protein TatB |
| 750 | Twin-arginine translocation protein TatA |
| 751 | FIG146285: Diadenosine tetraphosphate (Ap4A) hydrolase and other HIT family hydrolases |
| 752 | Phosphoribosyl-ATP pyrophosphatase (EC 3.6.1.31) |
| 753 | Phosphoribosyl-AMP cyclohydrolase (EC 3.5.4.19) |
| 754 | Imidazole glycerol phosphate synthase cyclase subunit (EC 4.1.3.—) |
| 755 | Phosphoribosylformimino-5-aminoimidazole carboxamide ribotide isomerase (EC 5.3.1.16) |
| 756 | Imidazole glycerol phosphate synthase amidotransferase subunit (EC 2.4.2.—) |
| 757 | Imidazoleglycerol-phosphate dehydratase (EC 4.2.1.19) |
| 758 | Histidinol-phosphate aminotransferase (EC 2.6.1.9) |
| 759 | Histidinol dehydrogenase (EC 1.1.1.23) |
| 760 | ATP phosphoribosyltransferase (EC 2.4.2.17) |
| 761 | Inner membrane protein |
| 762 | Cytochrome oxidase biogenesis protein Sco1/SenC/PrrC, putative copper metallochaperone |
| 763 | Heme O synthase, protoheme IX farnesyltransferase (EC 2.5.1.—) COX10-CtaB |
| 764 | Heme A synthase, cytochrome oxidase biogenesis protein Cox15-CtaA |
| 765 | hypothetical protein in Cytochrome oxidase biogenesis cluster |
| 766 | Cytochrome oxidase biogenesis protein Surf1, facilitates heme A insertion |
| 767 | hypothetical protein |
| 768 | Cytochrome c oxidase polypeptide III (EC 1.9.3.1) |
| 769 | hypothetical protein |
| 770 | Cytochrome oxidase biogenesis protein Cox11-CtaG, copper delivery to Cox1 |
| 771 | Cytochrome c oxidase polypeptide I (EC 1.9.3.1) |
| 772 | Cytochrome c oxidase polypeptide II (EC 1.9.3.1) |
| 773 | Beta-lactamase class D |
| 774 | Dethiobiotin synthetase (EC 6.3.3.3) |
| 775 | Muramoyltetrapeptide carboxypeptidase (EC 3.4.17.13) |
| 776 | hypothetical protein |
| 777 | 2-isopropylmalate synthase (EC 2.3.3.13) |
| 778 | hypothetical protein |
| 779 | Phosphatidylserine decarboxylase (EC 4.1.1.65) |
| 780 | hypothetical protein |
| 781 | Ketol-acid reductoisomerase (EC 1.1.1.86) |
| 782 | Acetolactate synthase small subunit (EC 2.2.1.6) |
| 783 | Acetolactate synthase large subunit (EC 2.2.1.6) |
| 784 | DNA-directed RNA polymerase specialized sigma subunit, sigma24-like |
| 785 | hypothetical protein |
| 786 | Probable transmembrane protein |
| 787 | Probable transmembrane protein |
| 788 | transcriptional regulator, LysR family |
| 789 | hypothetical protein |
| 790 | hypothetical protein |
| 791 | Guanine deaminase (EC 3.5.4.3) |
| 792 | Transcriptional regulator, MarR family |
| 793 | Manganese transport protein MntH |
| 794 | FIG016425: Soluble lytic murein transglycosylase and related regulatory proteins (some contain LysM/invasin domains) |
| 795 | Prolyl-tRNA synthetase (EC 6.1.1.15) |
| 796 | Kup system potassium uptake protein |
| 797 | hypothetical protein |

TABLE 19-continued

| SEQ ID NO. | function |
|---|---|
| 798 | hypothetical protein |
| 799 | hypothetical protein |
| 800 | Putative preQ0 transporter |
| 801 | probable anthranilate synthase (EC: 4.1.3.27) |
| 802 | hypothetical protein |
| 803 | N-acetylmuramoyl-L-alanine amidase (EC 3.5.1.28) AmpD |
| 804 | hypothetical protein |
| 805 | Transaldolase (EC 2.2.1.2) |
| 806 | Phosphate regulon sensor protein PhoR (SphS) (EC 2.7.13.3) |
| 807 | Phosphate regulon transcriptional regulatory protein PhoB (SphR) |
| 808 | probable transcriptional regulator |
| 809 | NADPH-dependent glyceraldehyde-3-phosphate dehydrogenase (EC 1.2.1.13)/NAD-dependent glyceraldehyde-3-phosphate dehydrogenase (EC 1.2.1.12) |
| 810 | PTS system, N-acetylglucosamine-specific IIA component (EC 2.7.1.69)/PTS system, N-acetylglucosamine-specific IIB component (EC 2.7.1.69)/PTS system, N-acetylglucosamine-specific IIC component (EC 2.7.1.69) |
| 811 | PTS system, glucose-specific IIA component (EC 2.7.1.69)/Phosphotransferase system, phosphocarrier protein HPr/Phosphoenolpyruvate-protein phosphotransferase of PTS system (EC 2.7.3.9) |
| 812 | Glucosamine-6-phosphate deaminase [isomerizing], alternative (EC 3.5.99.6) |
| 813 | N-acetylglucosamine-6-phosphate deacetylase (EC 3.5.1.25) |
| 814 | Predicted transcriptional regulator of N-Acetylglucosamine utilization, GntR family |
| 815 | probable carbohydrate-binding protein |
| 816 | Permease of the drug/metabolite transporter (DMT) superfamily |
| 817 | MotA/TolQ/ExbB proton channel family protein |
| 818 | YrdC/Sua5 family protein, required for threonylcarbamoyladenosine (t(6)A) formation in tRNA |
| 819 | hypothetical protein |
| 820 | Phosphoribosylamine--glycine ligase (EC 6.3.4.13) |
| 821 | IMP cyclohydrolase (EC 3.5.4.10)/Phosphoribosylaminoimidazolecarboxamide formyltransferase (EC 2.1.2.3) |
| 822 | DNA-binding protein Fis |
| 823 | tRNA dihydrouridine synthase B (EC 1.—.—.—) |
| 824 | diguanylate cyclase/phosphodiesterase (GGDEF & EAL domains) with PAS/PAC sensor(s) |
| 825 | Isochorismatase (EC 3.3.2.1) |
| 826 | Transcriptional regulator, MarR family |
| 827 | hypothetical protein |
| 828 | hypothetical protein |
| 829 | hypothetical protein |
| 830 | conserved hypothetical protein |
| 831 | Fusaric acid resistance protein fusE |
| 832 | hypothetical protein |
| 833 | FUSARIC ACID RESISTANCE PROTEIN FUSB/FUSARIC ACID RESISTANCE PROTEIN FUSC |
| 834 | Outer membrane component of tripartite multidrug resistance system |
| 835 | probable periplasmic protein |
| 836 | Outer membrane protein |
| 837 | hypothetical protein |
| 838 | hypothetical protein |
| 839 | Transcriptional regulator, TetR family |
| 840 | FIG00460803: hypothetical protein |
| 841 | hypothetical protein |
| 842 | HAD-superfamily hydrolase, putative |
| 843 | hypothetical protein |
| 844 | hypothetical protein |
| 845 | hypothetical protein |
| 846 | protein of unknown function DUF1568 |
| 847 | GGDEF family protein |
| 848 | Mobile element protein |
| 849 | tRNA-Arg-CCT |
| 850 | Octaprenyl diphosphate synthase (EC 2.5.1.90) |
| 851 | LSU ribosomal protein L21p |
| 852 | LSU ribosomal protein L27p |
| 853 | GTP-binding protein Obg |
| 854 | Histidine ABC transporter, histidine-binding periplasmic protein precursor HisJ (TC 3.A.1.3.1) |
| 855 | Histidine ABC transporter, permease protein HisQ (TC 3.A.1.3.1) |
| 856 | Histidine ABC transporter, permease protein HisM (TC 3.A.1.3.1) |
| 857 | Histidine ABC transporter, ATP-binding protein HisP (TC 3.A.1.3.1) |
| 858 | hypothetical protein |
| 859 | hypothetical protein |
| 860 | Succinylglutamate desuccinylase/aspartoacylase |
| 861 | FIG00348406: hypothetical protein |
| 862 | hypothetical protein |
| 863 | SMC protein-like |
| 864 | Probable dipeptidyl aminopeptidase |
| 865 | Transcriptional regulator, MarR family |

TABLE 19-continued

| SEQ ID NO. | function |
|---|---|
| 866 | Superoxide dismutase [Fe] (EC 1.15.1.1) |
| 867 | hypothetical protein |
| 868 | Thiol peroxidase, Tpx-type (EC 1.11.1.15) |
| 869 | Amino acid transporter |
| 870 | hypothetical protein |
| 871 | probable methyl-accepting chemotaxis protein |
| 872 | hypothetical protein |
| 873 | carbonic anhydrase, family 3 |
| 874 | Oligopeptidase A (EC 3.4.24.70) |
| 875 | Exodeoxyribonuclease III (EC 3.1.11.2) |
| 876 | hypothetical protein |
| 877 | Ku domain protein |
| 878 | Ferredoxin--NADP(+) reductase (EC 1.18.1.2) |
| 879 | probable glycosyltransferase |
| 880 | Ser/Thr protein phosphatase family protein, UDP-2,3-diacylglucosamine hydrolase (EC 3.6.1.—) homolog |
| 881 | probable 5-carboxymethyl-2-hydroxymuconate D-isomerase (EC: 5.3.3.10) |
| 882 | hypothetical protein |
| 883 | Cytochrome-c peroxidase (EC: 1.11.1.5) |
| 884 | hypothetical protein |
| 885 | TonB-dependent receptor |
| 886 | Sensor histidine kinase PrrB (RegB) (EC 2.7.3.—) |
| 887 | Dna binding response regulator PrrA (RegA) |
| 888 | hypothetical protein |
| 889 | Long-chain-fatty-acid--CoA ligase (EC 6.2.1.3) |
| 890 | hypothetical protein |
| 891 | hypothetical protein |
| 892 | D-2-hydroxyglutarate dehydrogenase |
| 893 | D-alanyl-D-alanine dipeptidase (EC 3.4.13.—) |
| 894 | Hemolysin |
| 895 | Maleylacetoacetate isomerase (EC 5.2.1.2)/Glutathione S-transferase |
| 896 | Acetate permease ActP (cation/acetate symporter) |
| 897 | hypothetical protein |
| 898 | acetyltransferase, GNAT family |
| 899 | hypothetical protein |
| 900 | Phospholipase C |
| 901 | Cold shock protein CspG |
| 902 | DNA polymerase III alpha subunit (EC 2.7.7.7) |
| 903 | hypothetical protein |
| 904 | Nitrilotriacetate monooxygenase component B (EC 1.14.13.—) |
| 905 | VirK |
| 906 | hypothetical protein |
| 907 | NADP-dependent malic enzyme (EC 1.1.1.40) |
| 908 | TRAP-type C4-dicarboxylate transport system, large permease component |
| 909 | TRAP-type transport system, small permease component, predicted N-acetylneuraminate transporter |
| 910 | TRAP-type C4-dicarboxylate transport system, periplasmic component |
| 911 | multisensor signal transduction histidine kinase |
| 912 | tRNA-Ala-CGC |
| 913 | Heat shock protein 60 family chaperone GroEL |
| 914 | Heat shock protein 60 family co-chaperone GroES |
| 915 | hypothetical protein |
| 916 | hypothetical protein |
| 917 | Outer membrane lipoprotein Blc |
| 918 | hypothetical protein |
| 919 | hypothetical protein |
| 920 | FIG002994: Putative transcriptional regulator |
| 921 | Oxidoreductase, short-chain dehydrogenase/reductase family (EC 1.1.1.—) |
| 922 | Cyclopropane-fatty-acyl-phospholipid synthase (EC 2.1.1.79), plant type |
| 923 | Hypothetical protein COG3496 |
| 924 | COG2907: Amine oxidase, flavin-containing |
| 925 | Transcriptional regulator, TetR family |
| 926 | hypothetical protein |
| 927 | ABC transporter related |
| 928 | amidotransferase-related protein |
| 929 | Transcriptional regulator, LysR family |
| 930 | hypothetical protein |
| 931 | Agmatine deiminase (EC 3.5.3.12) |
| 932 | FIG00456986: hypothetical protein |
| 933 | Aromatic hydrocarbon utilization transcriptional regulator CatR (LysR family) |
| 934 | small molecule metabolism; energy transfer; electron transport |
| 935 | Cytochrome c4 |
| 936 | 2,4-dienoyl-CoA reductase [NADPH] (EC 1.3.1.34) |
| 937 | hypothetical protein |
| 938 | probable transcriptional regulator, MerR family |
| 939 | Acyl-homoserine lactone acylase PvdQ (EC 3.5.1.—), quorum-quenching |

TABLE 19-continued

| SEQ ID NO. | function |
|---|---|
| 940 | Chitosanase precursor (EC 3.2.1.132) |
| 941 | conserved hypothetical protein, CHAD family |
| 942 | 3-oxoacyl-[acyl-carrier protein] reductase (EC 1.1.1.100) |
| 943 | Chloride channel protein |
| 944 | hypothetical protein |
| 945 | hypothetical protein |
| 946 | hypothetical protein |
| 947 | Small Subunit Ribosomal RNA; ssuRNA; SSU rRNA |
| 948 | Small Subunit Ribosomal RNA; ssuRNA; SSU rRNA |
| 949 | Small Subunit Ribosomal RNA; ssuRNA; SSU rRNA |
| 950 | Thioredoxin |
| 951 | Sodium/glutamate symport protein |
| 952 | hypothetical protein |
| 953 | 23S rRNA (guanine-N-2-)-methyltransferase rlmL EC 2.1.1.—) |
| 954 | Phosphopantetheine adenylyltransferase (EC 2.7.7.3) |
| 955 | PhnB protein; putative DNA binding 3-demethylubiquinone-9 3-methyltransferase domain protein |
| 956 | Dipeptide transport ATP-binding protein DppF (TC 3.A.1.5.2) |
| 957 | Dipeptide transport ATP-binding protein DppD (TC 3.A.1.5.2) |
| 958 | Dipeptide transport system permease protein DppC (TC 3.A.1.5.2) |
| 959 | Dipeptide transport system permease protein DppB (TC 3.A.1.5.2) |
| 960 | Dipeptide-binding ABC transporter, periplasmic substrate-binding component (TC 3.A.1.5.2) |
| 961 | 3-oxoacyl-[acyl-carrier-protein] synthase, KASIII (EC 2.3.1.41) |
| 962 | hypothetical protein |
| 963 | Iron-sulfur cluster regulator IscR |
| 964 | Cysteine desulfurase (EC 2.8.1.7), IscS subfamily |
| 965 | Iron-sulfur cluster assembly scaffold protein IscU |
| 966 | Iron binding protein IscA for iron-sulfur cluster assembly |
| 967 | Chaperone protein HscB |
| 968 | Chaperone protein HscA |
| 969 | Ferredoxin, 2Fe—2S |
| 970 | Believed to be involved in assembly of Fe—S clusters |
| 971 | Diaminopimelate decarboxylase |
| 972 | Fatty acid desaturase |
| 973 | Aspartate-semialdehyde dehydrogenase (EC 1.2.1.11) |
| 974 | hypothetical protein |
| 975 | hypothetical protein |
| 976 | hypothetical protein |
| 977 | Glutathione S-transferase (EC 2.5.1.18) |
| 978 | Uridine kinase (EC 2.7.1.48) [C1] |
| 979 | hypothetical protein |
| 980 | Conserved secreted protein |
| 981 | hypothetical protein |
| 982 | probable methyl-accepting chemotaxis protein |
| 983 | hypothetical protein |
| 984 | probable transcription regulator protein, LysR family |
| 985 | hypothetical protein |
| 986 | Transcriptional regulator, TetR family |
| 987 | Succinyl-CoA ligase [ADP-forming] alpha chain (EC 6.2.1.5) |
| 988 | Succinyl-CoA ligase [ADP-forming] beta chain (EC 6.2.1.5) |
| 989 | Dihydrolipoamide dehydrogenase of 2-oxoglutarate dehydrogenase (EC 1.8.1.4) |
| 990 | hypothetical protein |
| 991 | Dihydrolipoamide succinyltransferase component (E2) of 2-oxoglutarate dehydrogenase complex (EC 2.3.1.61) |
| 992 | 2-oxoglutarate dehydrogenase E1 component (EC 1.2.4.2) |
| 993 | Citrate synthase (si) (EC 2.3.3.1) |
| 994 | YgfY COG2938 |
| 995 | Succinate dehydrogenase iron-sulfur protein (EC 1.3.99.1) |
| 996 | Succinate dehydrogenase flavoprotein subunit (EC 1.3.99.1) |
| 997 | Succinate dehydrogenase hydrophobic membrane anchor protein |
| 998 | Succinate dehydrogenase cytochrome b-556 subunit |
| 999 | Putative alkanesulfonate metabolism utilization regulator |
| 1000 | Malate dehydrogenase (EC 1.1.1.37) |
| 1001 | Peptide chain release factor 2; programmed frameshift-containing |
| 1002 | Lysyl-tRNA synthetase (class II) (EC 6.1.1.6) |
| 1003 | prophage PSPPH06, putative reverse transcriptase/maturase |
| 1004 | probable transcriptional regulator |
| 1005 | hypothetical protein |
| 1006 | hypothetical protein |
| 1007 | Gfa-like protein |
| 1008 | contains type I hydrophobic transmembrane region and ATP/GTP binding motif |
| 1009 | putative methyl-accepting chemotaxis protein |
| 1010 | hypothetical protein |
| 1011 | hypothetical protein |
| 1012 | probable acetyltransferase |

TABLE 19-continued

| SEQ ID NO. | function |
|---|---|
| 1013 | Permeases of the major facilitator superfamily |
| 1014 | Transcriptional regulator, LysR family |
| 1015 | hypothetical protein |
| 1016 | hypothetical protein |
| 1017 | L-gulono-1,4-lactone oxidase (EC 1.1.3.8) |
| 1018 | oxidoreductase, FAD-binding |
| 1019 | cytochrome c5 |
| 1020 | hypothetical protein |
| 1021 | periplasmic protein, function unknown |
| 1022 | hypothetical protein |
| 1023 | hypothetical protein |
| 1024 | hypothetical protein |
| 1025 | diguanylate cyclase/phosphodiesterase (GGDEF & EAL domains) with PAS/PAC sensor(s) |
| 1026 | S-adenosylhomocysteine deaminase (EC 3.5.4.28); Methylthioadenosine deaminase |
| 1027 | 3-demethylubiquinol 3-O-methyltransferase (EC 2.1.1.64) |
| 1028 | transcriptional regulator, GntR family |
| 1029 | Dihydrofolate reductase (EC 1.5.1.3) |
| 1030 | Thymidylate synthase (EC 2.1.1.45) |
| 1031 | Flagellar biosynthesis protein FlhB |
| 1032 | Flagellar biosynthesis protein FlhA |
| 1033 | Flagellar biosynthesis protein FlhF |
| 1034 | Flagellar synthesis regulator FleN |
| 1035 | RNA polymerase sigma factor for flagellar operon |
| 1036 | Flagellar motor rotation protein MotA |
| 1037 | DNA polymerase III epsilon subunit (EC 2.7.7.7) |
| 1038 | tRNA-Arg-ACG |
| 1039 | tRNA-Glu-TTC |
| 1040 | tRNA-Arg-ACG |
| 1041 | tRNA-Glu-TTC |
| 1042 | FIG00964523: hypothetical protein |
| 1043 | Transcriptional regulator, GntR family domain/Aspartate aminotransferase (EC 2.6.1.1) |
| 1044 | TonB-dependent receptor |
| 1045 | tRNA-Glu-TTC |
| 1046 | tRNA-Arg-ACG |
| 1047 | tRNA-Ser-GCT |
| 1048 | Aspartokinase (EC 2.7.2.4) |
| 1049 | Methyl-accepting chemotaxis protein |
| 1050 | Chemotaxis regulator - transmits chemoreceptor signals to flagelllar motor components CheY |
| 1051 | hypothetical protein |
| 1052 | Signal transduction histidine kinase CheA (EC 2.7.3.—) |
| 1053 | Methyl-accepting chemotaxis protein I (serine chemoreceptor protein) |
| 1054 | Positive regulator of CheA protein activity (CheW) |
| 1055 | Methyl-accepting chemotaxis protein |
| 1056 | Chemotaxis protein CheD |
| 1057 | Chemotaxis response regulator protein-glutamate methylesterase CheB (EC 3.1.1.61) |
| 1058 | probable two-component response regulator |
| 1059 | YihE protein, required for LPS synthesis |
| 1060 | hypothetical protein |
| 1061 | Cobalt-zinc-cadmium resistance protein |
| 1062 | hypothetical protein |
| 1063 | hypothetical protein |
| 1064 | ATP-dependent RNA helicase Bcep18194_A5658 |
| 1065 | Adenosylcobinamide-phosphate synthase |
| 1066 | hypothetical protein |
| 1067 | Negative regulator of flagellin synthesis |
| 1068 | Flagellar basal-body P-ring formation protein FlgA |
| 1069 | Outer membrane esterase |
| 1070 | Threonine synthase (EC 4.2.3.1) |
| 1071 | hypothetical protein |
| 1072 | Homoserine dehydrogenase (EC 1.1.1.3) |
| 1073 | hypothetical protein |
| 1074 | Aspartate aminotransferase (EC 2.6.1.1) |
| 1075 | hypothetical protein |
| 1076 | Membrane protein |
| 1077 | 4-hydroxybenzoate transporter |
| 1078 | NADH dehydrogenase (EC 1.6.99.3) |
| 1079 | Ubiquinone biosynthesis monooxygenase UbiB |
| 1080 | Protein YigP (COG3165) clustered with ubiquinone biosynthetic genes |
| 1081 | D-alanyl-D-alanine carboxypeptidase (EC 3.4.16.4) |
| 1082 | Ubiquinone/menaquinone biosynthesis methyltransferase UbiE (EC 2.1.1.—) @ 2-heptaprenyl-1,4-naphthoquinone methyltransferase (EC 2.1.1.163) |
| 1083 | FIG028220: hypothetical protein co-occurring with HEAT repeat protein |
| 1084 | S-adenosylmethionine:tRNA ribosyltransferase-isomerase (EC 5.—.—.—) |
| 1085 | hypothetical protein |
| 1086 | 3-dehydroquinate dehydratase II (EC 4.2.1.10) |

TABLE 19-continued

| SEQ ID NO. | function |
|---|---|
| 1087 | Biotin carboxyl carrier protein of acetyl-CoA carboxylase |
| 1088 | Biotin carboxylase of acetyl-CoA carboxylase (EC 6.3.4.14) |
| 1089 | Ribosomal protein L11 methyltransferase (EC 2.1.1.—) |
| 1090 | probable transmembrane protein |
| 1091 | hypothetical protein |
| 1092 | hypothetical protein |
| 1093 | Transcriptional regulator, LysR family |
| 1094 | putative membrane protein |
| 1095 | PROBABLE MULTIFUNCTIONAL PROTEIN:PHOSPHOCARRIER PROTEIN HPR (PROTEIN H) AND PHOSPHOENOLPYRUVATE-PROTEIN PHOSPHOTRANSFERASE (EC: 2.7.3.9) |
| 1096 | PTS system, glucose-specific IIB component (EC 2.7.1.69)/PTS system, glucose-specific IIC component (EC 2.7.1.69) |
| 1097 | Cof protein, HD superfamily hydrolase |
| 1098 | surface presentation of antigens, secretory protein |
| 1099 | hypothetical protein |
| 1100 | hypothetical protein |
| 1101 | probable tyrosine phosphatase |
| 1102 | hypothetical protein |
| 1103 | hypothetical protein |
| 1104 | tRNA-Phe-GAA |
| 1105 | tRNA-Phe-GAA |
| 1106 | Maleylacetoacetate isomerase (EC 5.2.1.2) @ Glutathione S-transferase, zeta (EC 2.5.1.18) |
| 1107 | Fumarylacetoacetase (EC 3.7.1.2) |
| 1108 | Homogentisate 1,2-dioxygenase (EC 1.13.11.5) |
| 1109 | 4-hydroxyphenylpyruvate dioxygenase (EC 1.13.11.27) |
| 1110 | Transcriptional regulator, AsnC family |
| 1111 | putative membrane protein |
| 1112 | 5,10-methylenetetrahydrofolate reductase (EC 1.5.1.20) |
| 1113 | Adenosylhomocysteinase (EC 3.3.1.1) |
| 1114 | hypothetical protein |
| 1115 | S-adenosylmethionine synthetase (EC 2.5.1.6) |
| 1116 | Lipid A biosynthesis lauroyl acyltransferase (EC 2.3.1.—) |
| 1117 | Lipid A biosynthesis lauroyl acyltransferase (EC 2.3.1.—) |
| 1118 | Ribonuclease I precursor (EC 3.1.27.6) |
| 1119 | hypothetical protein |
| 1120 | NADH-ubiquinone oxidoreductase chain N (EC 1.6.5.3) |
| 1121 | NADH-ubiquinone oxidoreductase chain M (EC 1.6.5.3) |
| 1122 | NADH-ubiquinone oxidoreductase chain L (EC 1.6.5.3) |
| 1123 | NADH-ubiquinone oxidoreductase chain K (EC 1.6.5.3) |
| 1124 | NADH-ubiquinone oxidoreductase chain J (EC 1.6.5.3) |
| 1125 | NADH-ubiquinone oxidoreductase chain I (EC 1.6.5.3) |
| 1126 | NADH-ubiquinone oxidoreductase chain H (EC 1.6.5.3) |
| 1127 | NADH-ubiquinone oxidoreductase chain G (EC 1.6.5.3) |
| 1128 | NADH-ubiquinone oxidoreductase chain F (EC 1.6.5.3) |
| 1129 | NADH-ubiquinone oxidoreductase chain E (EC 1.6.5.3) |
| 1130 | NADH-ubiquinone oxidoreductase chain D (EC 1.6.5.3) |
| 1131 | NADH-ubiquinone oxidoreductase chain C (EC 1.6.5.3) |
| 1132 | NADH-ubiquinone oxidoreductase chain B (EC 1.6.5.3) |
| 1133 | NADH ubiquinone oxidoreductase chain A (EC 1.6.5.3) |
| 1134 | tRNA-Leu-GAG |
| 1135 | Preprotein translocase subunit SecG (TC 3.A.5.1.1) |
| 1136 | Triosephosphate isomerase (EC 5.3.1.1) |
| 1137 | Phosphate ABC transporter, periplasmic phosphate-binding protein PstS (TC 3.A.1.7.1) |
| 1138 | Phosphate transport system permease protein PstC (TC 3.A.1.7.1) |
| 1139 | Phosphate transport system permease protein PstA (TC 3.A.1.7.1) |
| 1140 | Phosphate transport ATP-binding protein PstB (TC 3.A.1.7.1) |
| 1141 | hypothetical protein |
| 1142 | Low-affinity inorganic phosphate transporter |
| 1143 | ATP-dependent DNA helicase RecG (EC 3.6.1.—) |
| 1144 | hypothetical protein |
| 1145 | Phenazine biosynthesis protein PhzF like |
| 1146 | hypothetical protein |
| 1147 | Endoribonuclease L-PSP |
| 1148 | Radical SAM family enzyme, similar to coproporphyrinogen III oxidase, oxygen-independent, clustered with nucleoside-triphosphatase RdgB |
| 1149 | Nucleoside 5-triphosphatase RdgB (dHAPTP, dITP, XTP-specific) (EC 3.6.1.15) |
| 1150 | ABC transporter, periplasmic spermidine putrescine-binding protein PotD (TC 3.A.1.11.1) |
| 1151 | tRNA dihydrouridine synthase A |
| 1152 | D-alanyl-D-alanine dipeptidase |
| 1153 | Dipeptide-binding ABC transporter, periplasmic substrate-binding component (TC 3.A.1.5.2) |
| 1154 | Succinylglutamate desuccinylase (EC 3.5.1.96) |
| 1155 | Uncharacterized protein ImpA |
| 1156 | hypothetical protein |

TABLE 19-continued

| SEQ ID NO. | function |
|---|---|
| 1157 | FIG00507168: hypothetical protein |
| 1158 | ClpB protein |
| 1159 | hypothetical protein |
| 1160 | Uncharacterized protein ImpH/VasB |
| 1161 | Protein ImpG/VasA |
| 1162 | hypothetical protein |
| 1163 | hypothetical protein |
| 1164 | hypothetical protein |
| 1165 | VgrG protein |
| 1166 | VgrG protein |
| 1167 | hypothetical protein |
| 1168 | Exonuclease, RNase T and DNA polymerase III |
| 1169 | hypothetical protein |
| 1170 | hypothetical protein |
| 1171 | Cell division protein FtsK |
| 1172 | hypothetical protein |
| 1173 | Recombinational DNA repair protein RecT (prophage associated) |
| 1174 | hypothetical protein |
| 1175 | hypothetical protein |
| 1176 | hypothetical protein |
| 1177 | hypothetical protein |
| 1178 | hypothetical protein |
| 1179 | hypothetical protein |
| 1180 | hypothetical protein |
| 1181 | hypothetical protein |
| 1182 | Phage terminase, small subunit |
| 1183 | hypothetical protein |
| 1184 | hypothetical protein |
| 1185 | hypothetical protein |
| 1186 | gene 66 protein |
| 1187 | hypothetical protein |
| 1188 | major virion structural protein |
| 1189 | hypothetical protein |
| 1190 | hypothetical protein |
| 1191 | hypothetical protein |
| 1192 | hypothetical protein |
| 1193 | hypothetical protein |
| 1194 | hypothetical protein |
| 1195 | hypothetical protein |
| 1196 | hypothetical protein |
| 1197 | hypothetical protein |
| 1198 | hypothetical protein |
| 1199 | hypothetical protein |
| 1200 | protein of unknown function DUF847 |
| 1201 | hypothetical protein |
| 1202 | 4'-phosphopantetheinyl transferase (EC 2.7.8.—) |
| 1203 | Fumarate hydratase class II (EC 4.2.1.2) |
| 1204 | UDP-glucose 4-epimerase (EC 5.1.3.2) |
| 1205 | FIG00506609: hypothetical protein |
| 1206 | Chorismate synthase (EC 4.2.3.5) |
| 1207 | Ethanolamine permease |
| 1208 | Ethanolamine ammonia-lyase heavy chain (EC 4.3.1.7) |
| 1209 | Ethanolamine ammonia-lyase light chain (EC 4.3.1.7) |
| 1210 | 2OG-Fe(II) oxygenase |
| 1211 | Endoribonuclease L-PSP |
| 1212 | Esterase/lipase/thioesterase family protein |
| 1213 | probable multidrug resistance protein |
| 1214 | probable ABC transporter protein |
| 1215 | small heat shock protein |
| 1216 | Membrane alanine aminopeptidase N (EC 3.4.11.2) |
| 1217 | hypothetical protein |
| 1218 | Cytochrome c oxidase subunit CcoN (EC 1.9.3.1) |
| 1219 | Cytochrome c oxidase subunit CcoO (EC 1.9.3.1) |
| 1220 | hypothetical protein |
| 1221 | Cytochrome c oxidase subunit CcoP (EC 1.9.3.1) |
| 1222 | Type cbb3 cytochrome oxidase biogenesis protein CcoG, involved in Cu oxidation |
| 1223 | Putative analog of CcoH, COG3198 |
| 1224 | probable MFS transporter |
| 1225 | hypothetical protein |
| 1226 | hypothetical protein |
| 1227 | Putative cytoplasmic protein |
| 1228 | hypothetical protein |
| 1229 | Glutathione S-transferase (EC 2.5.1.18) |
| 1230 | Tryptophanase (EC 4.1.99.1) |
| 1231 | hypothetical protein |
| 1232 | Di-/tripeptide transporter |

TABLE 19-continued

| SEQ ID NO. | function |
|---|---|
| 1233 | Polymyxin resistance protein ArnT, undecaprenyl phosphate-alpha-L-Ara4N transferase; Melittin resistance protein PqaB |
| 1234 | Polymyxin resistance protein ArnC, glycosyl transferase (EC 2.4.—.—) |
| 1235 | GtrA family protein |
| 1236 | hypothetical protein |
| 1237 | Ribosomal large subunit pseudouridine synthase D (EC 4.2.1.70) |
| 1238 | cytosolic long-chain acyl-CoA thioester hydrolase family protein |
| 1239 | SrpA-related protein |
| 1240 | Lead, cadmium, zinc and mercury transporting ATPase (EC 3.6.3.3) (EC 3.6.3.5); Copper-translocating P-type ATPase (EC 3.6.3.4) |
| 1241 | hypothetical protein |
| 1242 | transcriptional regulator, MerR family |
| 1243 | CidA-associated membrane protein CidB |
| 1244 | Holin-like protein CidA |
| 1245 | LysR family regulatory protein CidR |
| 1246 | 23S rRNA (guanosine-2'-O-)-methyltransferase rlmB (EC 2.1.1.—) |
| 1247 | Sensory box/GGDEF family protein |
| 1248 | hypothetical protein |
| 1249 | Transcription-repair coupling factor |
| 1250 | ABC-type amino acid transport/signal transduction systems, periplasmic component/domain |
| 1251 | hypothetical protein |
| 1252 | hypothetical protein |
| 1253 | hypothetical protein |
| 1254 | hypothetical protein |
| 1255 | Aldo-keto reductase |
| 1256 | Transcriptional regulator, LysR family |
| 1257 | D-serine/D-alanine/glycine transporter |
| 1258 | Alcohol dehydrogenase (EC 1.1.1.1); Acetaldehyde dehydrogenase (EC 1.2.1.10) |
| 1259 | hypothetical protein |
| 1260 | putative carbonic anhydrase (EC: 4.2.1.1) |
| 1261 | Permease of the drug/metabolite transporter (DMT) superfamily |
| 1262 | hypothetical protein |
| 1263 | hypothetical protein |
| 1264 | hypothetical protein |
| 1265 | hypothetical protein |
| 1266 | 2-octaprenyl-3-methyl-6-methoxy-1,4-benzoquinol hydroxylase (EC 1.14.13.—) |
| 1267 | Dienelactone hydrolase and related enzymes-like |
| 1268 | Glycerol-3-phosphate dehydrogenase [NAD(P)+] (EC 1.1.1.94) |
| 1269 | FIG00859406: hypothetical protein |
| 1270 | Protein export cytoplasm chaperone protein (SecB, maintains protein to be exported in unfolded state) |
| 1271 | Glutaredoxin 3 (Grx3) |
| 1272 | D-alanyl-D-alanine carboxypeptidase (EC 3.4.16.4) |
| 1273 | Helicase PriA essential for oriC/DnaA-independent DNA replication |
| 1274 | hypothetical protein |
| 1275 | Uroporphyrinogen III decarboxylase (EC 4.1.1.37) |
| 1276 | hypothetical protein |
| 1277 | Chromate transport protein ChrA |
| 1278 | Chromate transport protein ChrA |
| 1279 | Transcriptional regulator, LysR family |
| 1280 | short chain dehydrogenase |
| 1281 | short chain dehydrogenase |
| 1282 | hypothetical protein |
| 1283 | Topoisomerase IV subunit B (EC 5.99.1.—) |
| 1284 | hypothetical protein |
| 1285 | Adenosine (5')-pentaphospho-(5'')-adenosine pyrophosphohydrolase (EC 3.6.1.—) |
| 1286 | CDP-diacylglycerol--serine O-phosphatidyltransferase (EC 2.7.8.8) |
| 1287 | Signal transduction histidine kinase |
| 1288 | Kef-type K+ transport systems, predicted NAD-binding component |
| 1289 | 5S RNA |
| 1290 | Mobile element protein |
| 1291 | Mobile element protein |
| 1292 | Aldehyde dehydrogenase (EC 1.2.1.3) |
| 1293 | Nitrate/nitrite transporter |
| 1294 | Mycobacteriophage Barnyard protein gp56 |
| 1295 | NgrB |
| 1296 | tRNA-Met-CAT |
| 1297 | putative membrane protein |
| 1298 | hypothetical protein |
| 1299 | Methionyl-tRNA synthetase (EC 6.1.1.10) |
| 1300 | Multidrug translocase MdfA |
| 1301 | Scaffold protein for [4Fe—4S] cluster assembly ApbC, MRP-like |
| 1302 | Glutamate racemase (EC 5.1.1.3) |
| 1303 | probable ribonuclease precursor |
| 1304 | probable Barstar |

TABLE 19-continued

| SEQ ID NO. | function |
|---|---|
| 1305 | Sodium:dicarboxylate symporter |
| 1306 | tRNA-Ser-CGA |
| 1307 | hypothetical protein |
| 1308 | hypothetical protein |
| 1309 | hypothetical protein |
| 1310 | Exonuclease, RNase T and DNA polymerase III |
| 1311 | Mobile element protein |
| 1312 | hypothetical protein |
| 1313 | UPF0246 protein YaaA |
| 1314 | D-tyrosyl-tRNA(Tyr) deacylase |
| 1315 | hypothetical protein |
| 1316 | Membrane-bound lytic murein transglycosylase D precursor (EC 3.2.1.—) |
| 1317 | Hydroxyacylglutathione hydrolase (EC 3.1.2.6) |
| 1318 | FIG005121: SAM-dependent methyltransferase (EC 2.1.1.—) |
| 1319 | Ribonuclease HI (EC 3.1.26.4) |
| 1320 | DNA polymerase III epsilon subunit (EC 2.7.7.7) |
| 1321 | 2-C-methyl-D-erythritol 4-phosphate cytidylyltransferase (EC 2.7.7.60) |
| 1322 | 2-C-methyl-D-erythritol 2,4-cyclodiphosphate synthase (EC 4.6.1.12) |
| 1323 | Ribose 5-phosphate isomerase A (EC 5.3.1.6) |
| 1324 | Phosphate transport system regulatory protein PhoU |
| 1325 | Exopolyphosphatase (EC 3.6.1.11) |
| 1326 | Magnesium and cobalt transport protein CorA |
| 1327 | Nicotinamidase (EC 3.5.1.19) |
| 1328 | Lead, cadmium, zinc and mercury transporting ATPase (EC 3.6.3.3) (EC 3.6.3.5); Copper-translocating P-type ATPase (EC 3.6.3.4) |
| 1329 | probable copper ion binding protein |
| 1330 | hypothetical protein |
| 1331 | hypothetical protein |
| 1332 | CAMP phosphodiesterases class-II:Metallo-beta-lactamase superfamily |
| 1333 | putative peptidase |
| 1334 | Chromate transport protein ChrA |
| 1335 | probable permease of ABC transporter |
| 1336 | ABC-type amino acid transport/signal transduction systems, periplasmic component/domain |
| 1337 | Prolipoprotein diacylglyceryl transferase (EC 2.4.99.—) |
| 1338 | hypothetical protein |
| 1339 | Dihydroxy-acid dehydratase (EC 4.2.1.9) |
| 1340 | hypothetical protein |
| 1341 | Spermidine export protein MdtI |
| 1342 | Spermidine export protein MdtJ |
| 1343 | hypothetical protein |
| 1344 | putative RecF protein |
| 1345 | FIG00507517: hypothetical protein |
| 1346 | FIG022886: Transcriptional regulator, LysR family |
| 1347 | Pirin-related protein |
| 1348 | Serine hydroxymethyltransferase (EC 2.1.2.1) |
| 1349 | hypothetical protein |
| 1350 | Ribonucleotide reductase transcriptional regulator NrdR |
| 1351 | Ribosomal-protein-L7p-serine acetyltransferase |
| 1352 | Diaminohydroxyphosphoribosylaminopyrimidine deaminase (EC 3.5.4.26)/5-amino-6-(5-phosphoribosylamino)uracil reductase (EC 1.1.1.193) |
| 1353 | hypothetical protein |
| 1354 | Thermostable carboxypeptidase 1 (EC 3.4.17.19) |
| 1355 | Alpha/beta hydrolase fold (EC 3.8.1.5) |
| 1356 | fimbrial subunit protein |
| 1357 | chaperone protein ecpD precursor |
| 1358 | Outer membrane usher protein FIMD |
| 1359 | putative exported protein |
| 1360 | hypothetical protein |
| 1361 | Permeases of the major facilitator superfamily |
| 1362 | Choline dehydrogenase (EC 1.1.99.1) |
| 1363 | Transcriptional regulator, LysR family |
| 1364 | Transcriptional regulator, AraC family |
| 1365 | Inosine-5'-monophosphate dehydrogenase (EC 1.1.1.205) |
| 1366 | hypothetical protein |
| 1367 | FIG00506028: hypothetical protein |
| 1368 | Excinuclease ABC subunit C |
| 1369 | CDP-diacylglycerol--glycerol-3-phosphate 3-phosphatidyltransferase (EC 2.7.8.5) |
| 1370 | tRNA-Gly-GCC |
| 1371 | tRNA-Gly-GCC |
| 1372 | tRNA-Gly-GCC |
| 1373 | tRNA-Gly-GCC |
| 1374 | tRNA-Gly-GCC |
| 1375 | tRNA-Gly-GCC |
| 1376 | tRNA-Cys-GCA |
| 1377 | Shufflon-specific DNA recombinase |

TABLE 19-continued

| SEQ ID NO. | function |
|---|---|
| 1378 | hypothetical protein |
| 1379 | hypothetical protein |
| 1380 | hypothetical protein |
| 1381 | bacteriophage replication gene A |
| 1382 | hypothetical protein |
| 1383 | hypothetical protein |
| 1384 | hypothetical protein |
| 1385 | hypothetical protein |
| 1386 | hypothetical protein |
| 1387 | DNA-binding protein, CopG family |
| 1388 | hypothetical protein |
| 1389 | hypothetical protein |
| 1390 | Gene D protein |
| 1391 | Phage tail protein |
| 1392 | phage tail tape measure protein, TP901 family |
| 1393 | phage tail E |
| 1394 | Major tail tube protein |
| 1395 | Phage tail sheath monomer |
| 1396 | hypothetical protein |
| 1397 | probable tail fiber assembly protein |
| 1398 | Phage tail fiber protein |
| 1399 | putative phage tail protein |
| 1400 | Baseplate assembly protein J |
| 1401 | Phage baseplate assembly protein |
| 1402 | phage baseplate assembly protein V |
| 1403 | DNA methylase |
| 1404 | Phage tail completion protein |
| 1405 | P2 phage tail completion R family protein |
| 1406 | Hypothetical Zinc-finger containing protein |
| 1407 | hypothetical protein |
| 1408 | Putative phage-encoded peptidoglycan binding protein |
| 1409 | PUTATIVE PHAGE-RELATED TRANSMEMBRANE PROTEIN |
| 1410 | hypothetical protein |
| 1411 | tail component protein |
| 1412 | Phage head completion-stabilization protein |
| 1413 | Phage terminase, endonuclease subunit |
| 1414 | Phage major capsid protein |
| 1415 | Phage capsid scaffolding protein |
| 1416 | Phage terminase, ATPase subunit |
| 1417 | hypothetical protein |
| 1418 | hypothetical protein |
| 1419 | probable transcriptional regulator; ThiJ/PfpI family protein |
| 1420 | Transcriptional regulator, AraC family |
| 1421 | tRNA-Leu-TAA |
| 1422 | hypothetical protein |
| 1423 | Chaperone protein HtpG |
| 1424 | Glyoxalase family protein |
| 1425 | Isochorismatase (EC 3.3.2.1) |
| 1426 | hypothetical protein |
| 1427 | hypothetical protein |
| 1428 | Segregation and condensation protein A |
| 1429 | probable hydrolase/nitrilase |
| 1430 | OsmC/Ohr family protein |
| 1431 | disulphide isomerase |
| 1432 | MutT/nudix family protein |
| 1433 | Undecaprenyl-diphosphatase (EC 3.6.1.27) |
| 1434 | probable methyl-accepting chemotaxis protein |
| 1435 | Exodeoxyribonuclease I (EC 3.1.11.1) |
| 1436 | Methylglutaconyl-CoA hydratase (EC 4.2.1.18) |
| 1437 | 3-oxoadipate enol-lactonase |
| 1438 | diguanylate cyclase/phosphodiesterase (GGDEF & EAL domains) with PAS/PAC sensor(s) |
| 1439 | Putrescine transport ATP-binding protein PotG (TC 3.A.1.11.2) |
| 1440 | oxidoreductase |
| 1441 | Hydrolase, alpha/beta fold family |
| 1442 | DNA mismatch repair protein MutL |
| 1443 | DedA protein |
| 1444 | Protein-export membrane protein SecF (TC 3.A.5.1.1) |
| 1445 | Protein-export membrane protein SecD (TC 3.A.5.1.1) |
| 1446 | Preprotein translocase subunit YajC (TC 3.A.5.1.1) |
| 1447 | tRNA-guanine transglycosylase (EC 2.4.2.29) |
| 1448 | tRNA-Val-GAC |
| 1449 | Threonyl-tRNA synthetase (EC 6.1.1.3) |
| 1450 | Translation initiation factor 3 |
| 1451 | LSU ribosomal protein L35p |
| 1452 | LSU ribosomal protein L20p |
| 1453 | Phenylalanyl-tRNA synthetase alpha chain (EC 6.1.1.20) |

TABLE 19-continued

| SEQ ID NO. | function |
|---|---|
| 1454 | Phenylalanyl-tRNA synthetase beta chain (EC 6.1.1.20) |
| 1455 | Integration host factor alpha subunit |
| 1456 | Transcriptional regulator, MerR family |
| 1457 | tRNA-Pro-GGG |
| 1458 | hypothetical protein |
| 1459 | transfer origin protein, TraL |
| 1460 | hypothetical protein |
| 1461 | hypothetical protein |
| 1462 | hypothetical protein |
| 1463 | PROBABLE PHAGE PHI-105 HOLIN-LIKE PROTEIN |
| 1464 | hypothetical protein |
| 1465 | Phage terminase large subunit |
| 1466 | hypothetical protein |
| 1467 | Phage portal protein |
| 1468 | hypothetical protein |
| 1469 | hypothetical protein |
| 1470 | peptidase S49 |
| 1471 | Phage major capsid protein |
| 1472 | hypothetical protein |
| 1473 | hypothetical protein |
| 1474 | hypothetical protein |
| 1475 | hypothetical protein |
| 1476 | hypothetical protein |
| 1477 | hypothetical protein |
| 1478 | hypothetical protein |
| 1479 | hypothetical protein |
| 1480 | hypothetical protein |
| 1481 | hypothetical protein |
| 1482 | hypothetical protein |
| 1483 | prophage LambdaSo, minor tail protein M |
| 1484 | Phage minor tail protein #Phage minor tail protein L |
| 1485 | Phage tail assembly protein #Phage tail assembly protein K |
| 1486 | hypothetical protein |
| 1487 | Phage tail fiber protein #Phage host specificity protein J |
| 1488 | hypothetical protein |
| 1489 | hypothetical protein |
| 1490 | hypothetical protein |
| 1491 | hypothetical protein |
| 1492 | putative phage holin |
| 1493 | Peptidoglycan-binding domain 1 |
| 1494 | hypothetical protein |
| 1495 | hypothetical protein |
| 1496 | hypothetical protein |
| 1497 | hypothetical protein |
| 1498 | VgrG protein |
| 1499 | probable trans-acting regulatory HvrA protein |
| 1500 | hypothetical protein |
| 1501 | SAM-dependent methyltransferases |
| 1502 | hypothetical protein |
| 1503 | Probable transmembrane protein |
| 1504 | Large-conductance mechanosensitive channel |
| 1505 | Permease of the drug/metabolite transporter (DMT) superfamily |
| 1506 | tRNA-Asn-GTT |
| 1507 | tRNA-Asn-GTT |
| 1508 | tRNA-Asn-GTT |
| 1509 | Folate-dependent protein for Fe/S cluster synthesis/repair in oxidative stress |
| 1510 | probable trans-acting regulatory HvrA protein |
| 1511 | hypothetical protein |
| 1512 | Predicted carboxypeptidase |
| 1513 | probable phasin |
| 1514 | PhbF |
| 1515 | hypothetical protein |
| 1516 | hypothetical protein |
| 1517 | hypothetical protein |
| 1518 | hypothetical protein |
| 1519 | Seryl-tRNA synthetase (EC 6.1.1.11) |
| 1520 | FIG065221: Holliday junction DNA helicase |
| 1521 | Translation elongation factor P |
| 1522 | hypothetical protein |
| 1523 | hypothetical protein |
| 1524 | hypothetical protein |
| 1525 | probable Rhs-family protein |
| 1526 | hypothetical protein |
| 1527 | probable Rhs-family protein |
| 1528 | probable Rhs-family protein |
| 1529 | VgrG protein |

TABLE 19-continued

| SEQ ID NO. | function |
|---|---|
| 1530 | probable transcriptional regulator |
| 1531 | hypothetical protein |
| 1532 | probable homoserine/homoserine lactone efflux protein |
| 1533 | Beta-phosphoglucomutase (EC 5.4.2.6) |
| 1534 | L-serine dehydratase (EC 4.3.1.17) |
| 1535 | Serine transporter |
| 1536 | Formate efflux transporter (TC 2.A.44 family) |
| 1537 | hypothetical protein |
| 1538 | Pyruvate formate-lyase (EC 2.3.1.54) |
| 1539 | Pyruvate formate-lyase activating enzyme (EC 1.97.1.4) |
| 1540 | Cytoplasmic copper homeostasis protein CutC |
| 1541 | GGDEF domain protein |
| 1542 | Gamma-glutamyltranspeptidase (EC 2.3.2.2) |
| 1543 | probable acetyltransferase |
| 1544 | hypothetical protein |
| 1545 | DNA-binding response regulator |
| 1546 | probable transmembrane sensor histidine kinase transcription regulator protein |
| 1547 | probable transmembrane sensor histidine kinase transcription regulator protein |
| 1548 | hypothetical protein |
| 1549 | Methylated-DNA--protein-cysteine methyltransferase (EC 2.1.1.63) |
| 1550 | Major facilitator superfamily precursor |
| 1551 | hypothetical protein |
| 1552 | hypothetical protein |
| 1553 | LysR family transcriptional regulator PA0133 |
| 1554 | hypothetical protein |
| 1555 | Omega-amino acid--pyruvate aminotransferase (EC 2.6.1.18) |
| 1556 | Methylmalonate-semialdehyde dehydrogenase (EC 1.2.1.27) |
| 1557 | hypothetical protein |
| 1558 | hypothetical protein |
| 1559 | Outer membrane protein romA |
| 1560 | hypothetical protein |
| 1561 | zinc-containing alcohol dehydrogenase superfamily protein |
| 1562 | probable transcriptional regulator |
| 1563 | hypothetical protein |
| 1564 | methyl parathion hydrolase (EC: 3.5.—) |
| 1565 | probable transcriptional regulator, LysR family |
| 1566 | hypothetical protein |
| 1567 | Ribonucleotide reductase of class II (coenzyme B12-dependent) (EC 1.17.4.1) |
| 1568 | putative exported protein |
| 1569 | hypothetical protein |
| 1570 | glutamine synthetase family protein |
| 1571 | hypothetical protein |
| 1572 | Agmatine deiminase (EC 3.5.3.12) |
| 1573 | transcriptional regulator, LysR family |
| 1574 | Transcriptional regulator, GntR family domain/Aspartate aminotransferase (EC 2.6.1.1) |
| 1575 | Type cbb3 cytochrome oxidase biogenesis protein CcoG, involved in Cu oxidation |
| 1576 | hypothetical protein |
| 1577 | hypothetical protein |
| 1578 | hypothetical protein |
| 1579 | hypothetical protein |
| 1580 | Methyl-accepting chemotaxis protein |
| 1581 | Multiple antibiotic resistance protein marC |
| 1582 | N-succinyl-L,L-diaminopimelate desuccinylase (EC 3.5.1.18) |
| 1583 | FIG138056: a glutathione-dependent thiol reductase |
| 1584 | Twitching motility protein PilT |
| 1585 | Long-chain-fatty-acid--CoA ligase (EC 6.2.1.3) |
| 1586 | FIG000325: clustered with transcription termination protein NusA |
| 1587 | Transcription termination protein NusA |
| 1588 | Translation initiation factor 2 |
| 1589 | Ribosome-binding factor A |
| 1590 | tRNA pseudouridine synthase B (EC 4.2.1.70) |
| 1591 | SSU ribosomal protein S15p (S13e) |
| 1592 | Polyribonucleotide nucleotidyltransferase (EC 2.7.7.8) |
| 1593 | hypothetical protein |
| 1594 | hypothetical protein |
| 1595 | 2-keto-3-deoxy-D-arabino-heptulosonate-7-phosphate synthase I alpha (EC 2.5.1.54) |
| 1596 | 2,3-dihydroxybenzoate-2,3-dehydrogenase (EC: 1.3.1.28) |
| 1597 | Isochorismatase (EC 3.3.2.1) of siderophore biosynthesis |
| 1598 | 2,3-dihydroxybenzoate-AMP ligase (EC 2.7.7.58) |
| 1599 | Isochorismate synthase (EC 5.4.4.2) of siderophore biosynthesis |
| 1600 | Long-chain-fatty-acid--CoA ligase (EC 6.2.1.3) |
| 1601 | Ferrichrome transport ATP-binding protein FhuC (TC 3.A.1.14.3) |
| 1602 | Iron(III) dicitrate transport system permease protein FecD (TC 3.A.1.14.1) |
| 1603 | Putative periplasmic substrate-binding transport protein |
| 1604 | hypothetical protein |
| 1605 | TonB-dependent receptor; Outer membrane receptor for ferrienterochelin and colicins |

TABLE 19-continued

| SEQ ID NO. | function |
|---|---|
| 1606 | hypothetical protein |
| 1607 | Beta-hexosaminidase (EC 3.2.1.52) |
| 1608 | hypothetical protein |
| 1609 | hypothetical protein |
| 1610 | Ferric iron ABC transporter, ATP-binding protein |
| 1611 | Ferric iron ABC transporter, permease protein |
| 1612 | Ferric iron ABC transporter, iron-binding protein |
| 1613 | Ferrous iron transport peroxidase EfeB |
| 1614 | FIG00456119: hypothetical protein |
| 1615 | Carbohydrate-selective porin |
| 1616 | Succinylornithine transaminase (EC 2.6.1.81) |
| 1617 | Arginine N-succinyltransferase (EC 2.3.1.109) |
| 1618 | Arginine N-succinyltransferase (EC 2.3.1.109) |
| 1619 | Succinylglutamic semialdehyde dehydrogenase (EC 1.2.1.71) |
| 1620 | Succinylarginine dihydrolase (EC 3.5.3.23) |
| 1621 | High-affinity branched-chain amino acid transport system permease protein LivH (TC 3.A.1.4.1) |
| 1622 | Branched-chain amino acid transport system permease protein LivM (TC 3.A.1.4.1) |
| 1623 | Branched-chain amino acid transport ATP-binding protein LivG (TC 3.A.1.4.1) |
| 1624 | Branched-chain amino acid transport ATP-binding protein LivF (TC 3.A.1.4.1) |
| 1625 | hypothetical protein |
| 1626 | ABC-type amino acid transport/signal transduction systems periplasmic component/domain-like protein |
| 1627 | Putative membrane protein |
| 1628 | Multidrug resistance protein D |
| 1629 | Transcriptional regulator, AraC family |
| 1630 | hypothetical protein |
| 1631 | Alkaline phosphatase (EC 3.1.3.1) |
| 1632 | Alkaline phosphatase (EC 3.1.3.1) |
| 1633 | hypothetical protein |
| 1634 | ATP-dependent helicase HrpA |
| 1635 | Putative metal chaperone, involved in Zn homeostasis, GTPase of COG0523 family |
| 1636 | hypothetical protein |
| 1637 | Zinc ABC transporter, periplasmic-binding protein ZnuA |
| 1638 | Zinc ABC transporter, ATP-binding protein ZnuC |
| 1639 | Zinc ABC transporter, inner membrane permease protein ZnuB |
| 1640 | hypothetical protein |
| 1641 | probable two-component sensor |
| 1642 | Two-component system sensor protein |
| 1643 | Two-component system regulatory protein |
| 1644 | probable methyl-accepting chemotaxis protein II |
| 1645 | Phosphate acetyltransferase (EC 2.3.1.8) |
| 1646 | Acetate kinase (EC 2.7.2.1) |
| 1647 | hypothetical protein |
| 1648 | probable dioxygenase, alpha subunit |
| 1649 | hypothetical protein |
| 1650 | Cell division protein DivIC (FtsB), stabilizes FtsL against RasP cleavage |
| 1651 | hypothetical protein |
| 1652 | Small Subunit Ribosomal RNA; ssuRNA; SSU rRNA |
| 1653 | Small Subunit Ribosomal RNA; ssuRNA; SSU rRNA |
| 1654 | Channel-forming transporter/cytolysins activator of TpsB family |
| 1655 | porin signal peptide protein |
| 1656 | Chaperone protein DnaJ |
| 1657 | Chaperone protein DnaK |
| 1658 | Heat shock protein GrpE |
| 1659 | hypothetical protein |
| 1660 | Isocitrate lyase (EC 4.1.3.1) |
| 1661 | hypothetical protein |
| 1662 | Ribonuclease E inhibitor RraA |
| 1663 | hypothetical protein |
| 1664 | probable amino acid ABC transporter |
| 1665 | Sel1 domain protein repeat-containing protein |
| 1666 | 2',3'-cyclic-nucleotide 2'-phosphodiesterase (EC 3.1.4.16) |
| 1667 | hypothetical protein |
| 1668 | Aspartate 1-decarboxylase (EC 4.1.1.11) |
| 1669 | Pantoate--beta-alanine ligase (EC 6.3.2.1) |
| 1670 | 3-methyl-2-oxobutanoate hydroxymethyltransferase (EC 2.1.2.11) |
| 1671 | Deoxyadenosine kinase (EC 2.7.1.76)/Deoxyguanosine kinase (EC 2.7.1.113) |
| 1672 | 2-amino-4-hydroxy-6-hydroxymethyldihydropteridine pyrophosphokinase (EC 2.7.6.3) |
| 1673 | Poly(A) polymerase (EC 2.7.7.19) |
| 1674 | Transcriptional regulator, LysR family |
| 1675 | Bifunctional protein: zinc-containing alcohol dehydrogenase; quinone oxidoreductase (NADPH:quinone reductase) (EC 1.1.1.—); Similar to arginate lyase |
| 1676 | hypothetical protein |
| 1677 | hypothetical protein |
| 1678 | hypothetical protein |

TABLE 19-continued

| SEQ ID NO. | function |
|---|---|
| 1679 | Glycine betaine-binding protein |
| 1680 | RND efflux system, outer membrane lipoprotein, NodT family |
| 1681 | Probable Co/Zn/Cd efflux system membrane fusion protein |
| 1682 | RND multidrug efflux transporter; Acriflavin resistance protein |
| 1683 | alpha/beta hydrolase fold |
| 1684 | Molybdopterin-guanine dinucleotide biosynthesis protein MobA |
| 1685 | Molybdopterin biosynthesis protein MoeA |
| 1686 | Molybdenum cofactor biosynthesis protein MoaB |
| 1687 | Formate dehydrogenase chain D (EC 1.2.1.2) |
| 1688 | Transcriptional regulator |
| 1689 | Putative formate dehydrogenase oxidoreductase protein |
| 1690 | probable sensor/response regulator hybrid |
| 1691 | Sensory box/GGDEF family protein |
| 1692 | Drug resistance transporter EmrB/QacA subfamily |
| 1693 | Transcriptional regulator, MarR family |
| 1694 | GTP-binding protein related to HflX |
| 1695 | ATP-dependent RNA helicase RhlE |
| 1696 | hypothetical protein |
| 1697 | tRNA-Ser-GGA |
| 1698 | tRNA-Ser-GGA |
| 1699 | COGs COG3146 |
| 1700 | NAD synthetase (EC 6.3.1.5)/Glutamine amidotransferase chain of NAD synthetase |
| 1701 | hypothetical protein |
| 1702 | Outer membrane lipoprotein carrier protein LolA |
| 1703 | Methyltransferase (EC 2.1.1.—) |
| 1704 | Recombination protein RecR |
| 1705 | hypothetical protein |
| 1706 | FIG000557: hypothetical protein co-occurring with RecR |
| 1707 | DNA polymerase III subunits gamma and tau (EC 2.7.7.7) |
| 1708 | Membrane-bound lytic murein transglycosylase B precursor (EC 3.2.1.—) |
| 1709 | Heat-inducible transcription repressor HrcA |
| 1710 | RecA protein |
| 1711 | Regulatory protein RecX |
| 1712 | hypothetical protein |
| 1713 | Alanyl-tRNA synthetase (EC 6.1.1.7) |
| 1714 | probable acetyltransferase |
| 1715 | hypothetical protein |
| 1716 | hypothetical protein |
| 1717 | Putative sulfate permease |
| 1718 | hypothetical protein |
| 1719 | Potassium-transporting ATPase A chain (EC 3.6.3.12) (TC 3.A.3.7.1) |
| 1720 | Potassium-transporting ATPase B chain (EC 3.6.3.12) (TC 3.A.3.7.1) |
| 1721 | Potassium-transporting ATPase C chain (EC 3.6.3.12) (TC 3.A.3.7.1) |
| 1722 | Osmosensitive K+ channel histidine kinase KdpD (EC 2.7.3.—) |
| 1723 | DNA-binding response regulator KdpE |
| 1724 | hypothetical protein |
| 1725 | Probable multidrug resistance protein norM (Multidrug-efflux transporter) |
| 1726 | UDP-N-acetylenolpyruvoylglucosamine reductase (EC 1.1.1.158) |
| 1727 | hypothetical protein |
| 1728 | probable membrane protein NMA1176 |
| 1729 | probable integral membrane protein |
| 1730 | Quinolinate phosphoribosyltransferase [decarboxylating] (EC 2.4.2.19) |
| 1731 | hypothetical protein |
| 1732 | Hypothetical nudix hydrolase YeaB |
| 1733 | putative membrane protein |
| 1734 | Transcription termination factor Rho |
| 1735 | Thioredoxin |
| 1736 | Enoyl-[acyl-carrier-protein] reductase [NADH] (EC 1.3.1.9) |
| 1737 | Transcriptional regulator, AraC family |
| 1738 | Organic hydroperoxide resistance protein |
| 1739 | Esterase/lipase |
| 1740 | inositol monophosphatase family protein |
| 1741 | hypothetical protein |
| 1742 | Chemotaxis protein methyltransferase (EC 2.1.1.80) |
| 1743 | probable two-component hybrid sensor and regulator (EC: 2.7.3.—) |
| 1744 | diguanylate cyclase/phosphodiesterase (GGDEF & EAL domains) with PAS/PAC sensor(s) |
| 1745 | Cobyric acid synthase |
| 1746 | Adenosylcobinamide-phosphate synthase |
| 1747 | L-threonine 3-O-phosphate decarboxylase (EC 4.1.1.81) |
| 1748 | hypothetical protein |
| 1749 | HoxN/HupN/NixA family cobalt transporter |
| 1750 | Putative 2Fe—2S ferredoxin CbiW involved in B12 biosynthesis |
| 1751 | CobN component of cobalt chelatase involved in B12 biosynthesis |
| 1752 | ChlI component of cobalt chelatase involved in B12 biosynthesis/ChlD component of cobalt chelatase involved in B12 biosynthesis |
| 1753 | Uroporphyrinogen-III methyltransferase (EC 2.1.1.107) |

TABLE 19-continued

| SEQ ID NO. | function |
|---|---|
| 1754 | Cobalt-precorrin-6y C5-methyltransferase (EC 2.1.1.—) |
| 1755 | Sirohydrochlorin cobaltochelatase (EC 4.99.1.3)/Cobalt-precorrin-8x methylmutase (EC 5.4.1.2) |
| 1756 | Cobalt-precorrin-6 synthase, anaerobic |
| 1757 | Cobalt-precorrin-2 C20-methyltransferase (EC 2.1.1.130) |
| 1758 | Cobalt-precorrin-4 C11-methyltransferase (EC 2.1.1.133) |
| 1759 | Cobalamin biosynthesis protein CbiG |
| 1760 | hypothetical protein |
| 1761 | Cobalt-precorrin-3b C17-methyltransferase/Cobalt-precorrin-6x reductase (EC 1.3.1.54) |
| 1762 | CobW GTPase involved in cobalt insertion for B12 biosynthesis |
| 1763 | ABC transporter (iron.B12.siderophore.hemin), ATP-binding component |
| 1764 | ABC transporter (iron.B12.siderophore.hemin), periplasmic substrate-binding component |
| 1765 | ABC transporter (iron.B12.siderophore.hemin), permease component |
| 1766 | Cob(I)alamin adenosyltransferase (EC 2.5.1.17) |
| 1767 | Cobyrinic acid A,C-diamide synthase |
| 1768 | Cobalamin biosynthesis protein BluB @ 5,6-dimethylbenzimidazole synthase, flavin destructase family |
| 1769 | lipase/acylhydrolase, putative |
| 1770 | hypothetical protein |
| 1771 | Enoyl-CoA hydratase (EC 4.2.1.17) |
| 1772 | acetyltransferase, GNAT family |
| 1773 | hypothetical protein |
| 1774 | Leucine-, isoleucine-, valine-, threonine-, and alanine-binding protein |
| 1775 | Proline dehydrogenase (EC 1.5.99.8) (Proline oxidase)/Delta-1-pyrroline-5-carboxylate dehydrogenase (EC 1.5.1.12) |
| 1776 | 5S RNA |
| 1777 | 5S RNA |
| 1778 | 5S RNA |
| 1779 | Aerotaxis sensor receptor protein |
| 1780 | Porphobilinogen synthase (EC 4.2.1.24) |
| 1781 | hypothetical protein |
| 1782 | 2-amino-3-ketobutyrate coenzyme A ligase (EC 2.3.1.29) |
| 1783 | L-threonine 3-dehydrogenase (EC 1.1.1.103) |
| 1784 | Methyl-accepting chemotaxis protein I (serine chemoreceptor protein) |
| 1785 | Protoporphyrinogen IX oxidase, aerobic, HemY (EC 1.3.3.4) |
| 1786 | Glycyl-tRNA synthetase alpha chain (EC 6.1.1.14) |
| 1787 | hypothetical protein |
| 1788 | Glycyl-tRNA synthetase beta chain (EC 6.1.1.14) |
| 1789 | Histidinol-phosphatase (EC 3.1.3.15) |
| 1790 | 1-acyl-sn-glycerol-3-phosphate acyltransferase (EC 2.3.1.51) |
| 1791 | Lactoylglutathione lyase (EC 4.4.1.5) |
| 1792 | Probable transmembrane protein |
| 1793 | hypothetical protein |
| 1794 | Lipoprotein YcfM, part of a salvage pathway of unknown substrate |
| 1795 | hypothetical protein |
| 1796 | putative lipoprotein |
| 1797 | UDP-N-acetylmuramate:L-alanyl-gamma-D-glutamyl-meso-diaminopimelate ligase (EC 6.3.2.—) |
| 1798 | hypothetical protein |
| 1799 | Putative sodium-dependent transporter |
| 1800 | hypothetical protein |
| 1801 | putative lipoprotein |
| 1802 | Isoquinoline 1-oxidoreductase alpha subunit (EC 1.3.99.16) |
| 1803 | Isoquinoline 1-oxidoreductase beta subunit (EC 1.3.99.16) |
| 1804 | Putative Isoquinoline 1-oxidoreductase subunit, Mll3835 protein |
| 1805 | Carbon monoxide dehydrogenase F protein |
| 1806 | CTP:molybdopterin cytidylyltransferase |
| 1807 | Methyl-accepting chemotaxis protein I (serine chemoreceptor protein) |
| 1808 | Putrescine transport ATP-binding protein PotA (TC 3.A.1.11.1) |
| 1809 | Thiamin ABC transporter, transmembrane component |
| 1810 | ABC transporter permease protein |
| 1811 | ABC-type Fe3+ transport system, periplasmic component |
| 1812 | Hydrogen cyanide synthase HcnC/Opine oxidase subunit B |
| 1813 | Hydrogen cyanide synthase HcnB/Opine oxidase subunit A |
| 1814 | Hydrogen cyanide synthase HcnA |
| 1815 | hypothetical protein |
| 1816 | hypothetical protein |
| 1817 | L-asparaginase (EC 3.5.1.1) |
| 1818 | Ribosylnicotinamide kinase (EC 2.7.1.22) |
| 1819 | FIG002958: hypothetical protein |
| 1820 | hypothetical protein |
| 1821 | COG0613, Predicted metal-dependent phosphoesterases (PHP family) |
| 1822 | YciO family |
| 1823 | Tryptophanyl-tRNA synthetase (EC 6.1.1.2) |

TABLE 19-continued

| SEQ ID NO. | function |
|---|---|
| 1824 | Methyl-accepting chemotaxis protein |
| 1825 | TonB-dependent receptor |
| 1826 | hypothetical protein |
| 1827 | hypothetical protein |
| 1828 | Flagellar basal-body P-ring formation protein FlgA |
| 1829 | Flagellar basal-body rod protein FlgB |
| 1830 | Flagellar basal-body rod protein FlgC |
| 1831 | Flagellar basal-body rod modification protein FlgD |
| 1832 | Flagellar hook protein FlgE |
| 1833 | Flagellar basal-body rod protein FlgF |
| 1834 | Flagellar basal-body rod protein FlgG |
| 1835 | Flagellar L-ring protein FlgH |
| 1836 | Flagellar P-ring protein FlgI |
| 1837 | COG3951: Rod binding protein |
| 1838 | Flagellar hook-associated protein FlgK |
| 1839 | Flagellar hook-associated protein FlgL |
| 1840 | hypothetical protein |
| 1841 | Phosphatidylserine/phosphatidylglycerophosphate/cardiolipi n synthases and related enzymes |
| 1842 | Asparagine synthetase [glutamine-hydrolyzing] (EC 6.3.5.4) |
| 1843 | P-hydroxybenzoate hydroxylase (EC 1.14.13.2) |
| 1844 | 2-Amino-2-deoxy-isochorismate synthase (EC 4.1.3.—) # TrpAa/TrpAb-PhzE type |
| 1845 | Glutathione S-transferase, unnamed subgroup 2 (EC 2.5.1.18) |
| 1846 | Transcriptional regulator, AsnC family |
| 1847 | hypothetical protein |
| 1848 | Methyl-accepting chemotaxis protein |
| 1849 | hypothetical protein |
| 1850 | Polyphosphate kinase 2 (EC 2.7.4.1) |
| 1851 | ABC transporter ATP-binding protein YvcR |
| 1852 | protein of unknown function DUF214 |
| 1853 | hypothetical protein |
| 1854 | hypothetical protein |
| 1855 | hypothetical protein |
| 1856 | Response regulator of the LytR/AlgR family |
| 1857 | Response regulator of the LytR/AlgR family |
| 1858 | Cupin 2, conserved barrel domain protein |
| 1859 | Sulfate permease |
| 1860 | hypothetical protein |
| 1861 | D-3-phosphoglycerate dehydrogenase (EC 1.1.1.95) |
| 1862 | Hypothetical hydrolase |
| 1863 | hypothetical protein |
| 1864 | hypothetical protein |
| 1865 | Putative 10 TMS drug/metabolite exporter, DME family, DMT superfamily |
| 1866 | Response regulator |
| 1867 | Histone acetyltransferase HPA2 and related acetyltransferases |
| 1868 | Selenoprotein O and cysteine-containing homologs |
| 1869 | Fe—S OXIDOREDUCTASE (1.8.—.—) |
| 1870 | hypothetical protein |
| 1871 | hypothetical protein |
| 1872 | Glutaminyl-tRNA synthetase (EC 6.1.1.18) |
| 1873 | UDP-sugar hydrolase (EC 3.6.1.45); 5'-nucleotidase (EC 3.1.3.5) |
| 1874 | hypothetical protein |
| 1875 | 6-phosphofructokinase (EC 2.7.1.11) |
| 1876 | Cysteinyl-tRNA synthetase (EC 6.1.1.16) |
| 1877 | 50S ribosomal protein L31 |
| 1878 | probable inner membrane protein NMA0497 |
| 1879 | hypothetical protein |
| 1880 | hypothetical protein |
| 1881 | Acetoacetyl-CoA synthetase [leucine] (EC 6.2.1.16) |
| 1882 | Hydroxymethylglutaryl-CoA lyase (EC 4.1.3.4) |
| 1883 | transcriptional regulator (AraC/XylS family) |
| 1884 | FOG: TPR repeat protein |
| 1885 | Methylcrotonyl-CoA carboxylase biotin-containing subunit (EC 6.4.1.4) |
| 1886 | Methylglutaconyl-CoA hydratase (EC 4.2.1.18) |
| 1887 | Methylcrotonyl-CoA carboxylase carboxyl transferase subunit (EC 6.4.1.4) |
| 1888 | conserved hypothetical protein |
| 1889 | Isovaleryl-CoA dehydrogenase (EC 1.3.99.10) |
| 1890 | Nudix dNTPase DR1776 (EC 3.6.1.—) |
| 1891 | probable P23 protein |
| 1892 | Putative resistance protein |
| 1893 | Hypothetical response regulatory protein ypdB |
| 1894 | Autolysis histidine kinase LytS |
| 1895 | Macrophage infectivity potentiator-related protein |
| 1896 | Transcriptional regulator, LysR family |
| 1897 | probable iron-sulfur binding protein YPO1417 |
| 1898 | Glutathione S-transferase, unnamed subgroup (EC 2.5.1.18) |

TABLE 19-continued

| SEQ ID NO. | function |
| --- | --- |
| 1899 | Transcriptional regulator, MarR family |
| 1900 | Permease of the drug/metabolite transporter (DMT) superfamily |
| 1901 | Probable acetyltransferase |
| 1902 | Predicted transcriptional regulator LiuR of leucine degradation pathway, MerR family |
| 1903 | Acetoacetyl-CoA synthetase (EC 6.2.1.16)/Long-chain-fatty-acid--CoA ligase (EC 6.2.1.3) |
| 1904 | Protein export cytoplasm protein SecA ATPase RNA helicase (TC 3.A.5.1.1) |
| 1905 | NADH-dependent butanol dehydrogenase A (EC 1.1.1.—) |
| 1906 | hypothetical protein |
| 1907 | hypothetical protein |
| 1908 | Acyl-CoA dehydrogenase (EC 1.3.99.3) |
| 1909 | hypothetical protein |
| 1910 | ADP-ribose pyrophosphatase (EC 3.6.1.13) |
| 1911 | hypothetical protein |
| 1912 | Serine protein kinase (prkA protein), P-loop containing |
| 1913 | hypothetical protein |
| 1914 | FIG002076: hypothetical protein |
| 1915 | FIG004684: SpoVR-like protein |
| 1916 | hypothetical protein |
| 1917 | ABC-type hemin transport system, ATPase component |
| 1918 | putative hemin permease |
| 1919 | Dihydrodipicolinate reductase (EC 1.3.1.26) |
| 1920 | Outer membrane lipoprotein SmpA, a component of the essential YaeT outer-membrane protein assembly complex |
| 1921 | Ferric uptake regulation protein FUR |
| 1922 | Leucyl/phenylalanyl-tRNA--protein transferase (EC 2.3.2.6) |
| 1923 | Arginine-tRNA-protein transferase (EC 2.3.2.8) |
| 1924 | PAL cross-reacting lipoprotein precursor |
| 1925 | Dihydroorotate dehydrogenase (EC 1.3.3.1) |
| 1926 | Nitroreductase |
| 1927 | Flagellar motor rotation protein MotB |
| 1928 | hypothetical protein |
| 1929 | Similar to phosphoglycolate phosphatase, clustered with ribosomal large subunit pseudouridine synthase C |
| 1930 | Ribosomal large subunit pseudouridine synthase C (EC 4.2.1.70) |
| 1931 | Ribonuclease E (EC 3.1.26.12) |
| 1932 | tRNA-Asn-GTT |
| 1933 | FIG01125970: hypothetical protein |
| 1934 | hydrolase, TatD family |
| 1935 | hypothetical protein |
| 1936 | FIG00961164: hypothetical protein |
| 1937 | hypothetical protein |
| 1938 | 3-dehydroquinate synthase (EC 4.2.3.4) |
| 1939 | hypothetical protein |
| 1940 | hypothetical protein |
| 1941 | Putative permease |
| 1942 | Permeases of the major facilitator superfamily |
| 1943 | Inner membrane protein |
| 1944 | Transcriptional regulator, AraC family |
| 1945 | Transcriptional regulator, AraC family |
| 1946 | probable FAD-dependent monooxygenase |
| 1947 | Alkanesulfonate utilization operon LysR-family regulator Cbl |
| 1948 | Sulfate and thiosulfate import ATP-binding protein CysA (EC 3.6.3.25) |
| 1949 | Sulfate transport system permease protein CysW |
| 1950 | Sulfate transport system permease protein CysT |
| 1951 | Sulfate-binding protein Sbp |
| 1952 | hypothetical protein |
| 1953 | hypothetical protein |
| 1954 | AttT protein |
| 1955 | hypothetical protein |
| 1956 | Transcriptional regulator, TetR family |
| 1957 | hypothetical protein |
| 1958 | hypothetical protein |
| 1959 | hypothetical protein |
| 1960 | Metal-dependent hydrolase involved in phosphonate metabolism |
| 1961 | Phosphonates transport ATP-binding protein PhnL |
| 1962 | Phosphonates transport ATP-binding protein PhnK |
| 1963 | PhnJ protein |
| 1964 | PhnI protein |
| 1965 | PhnH protein |
| 1966 | PhnG protein |
| 1967 | Transcriptional regulator PhnF |
| 1968 | Protein RcsF |
| 1969 | ATP-binding protein PhnN; Guanylate kinase (EC 2.7.4.8) |
| 1970 | beta/gamma crystallin family protein |
| 1971 | hypothetical protein |

TABLE 19-continued

| SEQ ID NO. | function |
|---|---|
| 1972 | hypothetical protein |
| 1973 | Sensory box/GGDEF family protein |
| 1974 | probable sensory box histidine kinase/response regulator (EC: 2.7.3.—) |
| 1975 | Periplasmic binding protein-related protein |
| 1976 | Ferric iron ABC transporter, iron-binding protein |
| 1977 | Ferric iron ABC transporter, ATP-binding protein |
| 1978 | Ferric iron ABC transporter, permease protein |
| 1979 | hypothetical protein |
| 1980 | hypothetical protein |
| 1981 | hypothetical protein |
| 1982 | Membrane carboxypeptidase (penicillin-binding protein) |
| 1983 | Transcriptional regulator, AraC family |
| 1984 | 4-hydroxyproline epimerase (EC 5.1.1.8) |
| 1985 | 1-pyrroline-4-hydroxy-2-carboxylate deaminase (EC 3.5.4.22) |
| 1986 | Ketoglutarate semialdehyde dehydrogenase (EC 1.2.1.26) |
| 1987 | D-amino acid dehydrogenase (EC 1.4.99.1) family protein in hydroxy-L-proline catabolic cluster |
| 1988 | Leucine-, isoleucine-, valine-, threonine-, and alanine-binding protein |
| 1989 | FKBP-type peptidyl-prolyl cis-trans isomerase SlyD (EC 5.2.1.8) |
| 1990 | hypothetical protein |
| 1991 | hypothetical protein |
| 1992 | Mobile element protein |
| 1993 | Mobile element protein |
| 1994 | Mobile element protein |
| 1995 | Single-stranded DNA-binding protein |
| 1996 | hypothetical protein |
| 1997 | Outer membrane lipoprotein omp16 precursor |
| 1998 | Putative transport protein |
| 1999 | Excinuclease ABC subunit A |
| 2000 | hypothetical protein |
| 2001 | putative thioredoxin |
| 2002 | hypothetical protein |
| 2003 | putative adenylate kinase |
| 2004 | Methylase of polypeptide chain release factors |
| 2005 | Chitinase (EC 3.2.1.14) |
| 2006 | hypothetical protein |
| 2007 | Translation initiation factor 1 |
| 2008 | Transcriptional regulator, GntR family domain/Aspartate aminotransferase (EC 2.6.1.1) |
| 2009 | Transporter, LysE family |
| 2010 | probable hydrolase |
| 2011 | hypothetical protein |
| 2012 | Permease of the drug/metabolite transporter (DMT) superfamily |
| 2013 | Transcriptional regulator, AraC family |
| 2014 | hypothetical protein |
| 2015 | FIG00506677: hypothetical protein |
| 2016 | tRNA proofreading protein STM4549 |
| 2017 | Leucine-responsive regulatory protein, regulator for leucine (or lrp) regulon and high-affinity branched-chain amino acid transport system |
| 2018 | D-amino acid dehydrogenase small subunit (EC 1.4.99.1) |
| 2019 | Alanine racemase (EC 5.1.1.1) |
| 2020 | Methyl-accepting chemotaxis protein |
| 2021 | Channel-forming transporter/cytolysins activator of TpsB family |
| 2022 | Hemolysin |
| 2023 | signal transduction histidine kinase |
| 2024 | Pirin |
| 2025 | Transcriptional regulator, LysR family |
| 2026 | Predicted regulator PutR for proline utilization, GntR family |
| 2027 | tRNA-His-GTG |
| 2028 | tRNA-His-GTG |
| 2029 | tRNA-His-GTG |
| 2030 | tRNA-Arg-TCT |
| 2031 | tRNA-Pro-TGG |
| 2032 | Methylenetetrahydrofolate dehydrogenase (NADP+) (EC 1.5.1.5)/ Methenyltetrahydrofolate cyclohydrolase (EC 3.5.4.9) |
| 2033 | Formyltetrahydrofolate deformylase (EC 3.5.1.10) |
| 2034 | hypothetical protein |
| 2035 | MuT/NUDIX protein |
| 2036 | Undecaprenyl-diphosphatase (EC 3.6.1.27) |
| 2037 | Protein export cytoplasm protein SecA ATPase RNA helicase (TC 3.A.5.1.1) |
| 2038 | Nucleoside permease NupC |
| 2039 | hypothetical protein |
| 2040 | 23S rRNA (Uracil-5-)-methyltransferase RumA (EC 2.1.1.—) |
| 2041 | Protein erfK/srfK precursor |
| 2042 | O-acetylhomoserine sulfhydrylase (EC 2.5.1.49)/O-succinylhomoserine sulfhydrylase (EC 2.5.1.48) |
| 2043 | Transcriptional regulator, GntR family domain/Aspartate aminotransferase (EC 2.6.1.1) |

TABLE 19-continued

| SEQ ID NO. | function |
|---|---|
| 2044 | Transporter, LysE family |
| 2045 | Glutamyl-tRNA synthetase (EC 6.1.1.17) |
| 2046 | Peroxidase (EC 1.11.1.7) |
| 2047 | hypothetical protein |
| 2048 | membrane protein |
| 2049 | 4-hydroxybenzoyl-CoA thioesterase |
| 2050 | hypothetical protein |
| 2051 | hypothetical protein |
| 2052 | ClpB protein |
| 2053 | DNA-3-methyladenine glycosylase (EC 3.2.2.20) |
| 2054 | hypothetical protein |
| 2055 | two-component response regulator |
| 2056 | FOG: CheY-like receiver |
| 2057 | hypothetical protein |
| 2058 | COG2833: uncharacterized protein |
| 2059 | hypothetical protein |
| 2060 | hypothetical protein |
| 2061 | Putrescine ABC transporter putrescine-binding protein PotF (TC 3.A.1.11.2) |
| 2062 | Putrescine transport system permease protein PotH (TC 3.A.1.11.2) |
| 2063 | Putrescine transport system permease protein PotI (TC 3.A.1.11.2) |
| 2064 | Uncharacterized protein in putrescine utilization cluster |
| 2065 | Outer membrane protein romA |
| 2066 | Arginyl-tRNA synthetase (EC 6.1.1.19) |
| 2067 | Putative heme iron utilization protein |
| 2068 | hypothetical protein |
| 2069 | TonB-dependent receptor |
| 2070 | Periplasmic protein TonB, links inner and outer membranes |
| 2071 | MotA/TolQ/ExbB proton channel family protein |
| 2072 | Biopolymer transport protein ExbD/TolR |
| 2073 | Biopolymer transport protein ExbD/TolR |
| 2074 | Biopolymer transport protein ExbD/TolR |
| 2075 | Biopolymer transport protein ExbD/TolR |
| 2076 | Membrane fusion protein of RND family multidrug efflux pump |
| 2077 | hypothetical protein |
| 2078 | Cobalt-zinc-cadmium resistance protein CzcA; Cation efflux system protein CusA |
| 2079 | hypothetical protein |
| 2080 | FIG00455869: hypothetical protein |
| 2081 | Oligopeptide transport system permease protein OppB (TC 3.A.1.5.1) |
| 2082 | Oligopeptide transport system permease protein OppC (TC 3.A.1.5.1) |
| 2083 | Dipeptide transport ATP-binding protein DppD (TC 3.A.1.5.2) |
| 2084 | PilV-like protein |
| 2085 | type II secretion system protein E |
| 2086 | Putative type IV pilin protein |
| 2087 | IncI1 plasmid conjugative transfer inner membrane protein PilR |
| 2088 | hypothetical protein |
| 2089 | hypothetical protein |
| 2090 | hypothetical protein |
| 2091 | hypothetical protein |
| 2092 | hypothetical protein |
| 2093 | hypothetical protein |
| 2094 | hypothetical protein |
| 2095 | hypothetical protein |
| 2096 | hypothetical protein |
| 2097 | COG2805: Tfp pilus assembly protein, pilus retraction ATPase PilT |
| 2098 | defect in organelle trafficking lipoprotein DotC |
| 2099 | hypothetical protein |
| 2100 | hypothetical protein |
| 2101 | hypothetical protein |
| 2102 | hypothetical protein |
| 2103 | hypothetical protein |
| 2104 | hypothetical protein |
| 2105 | hypothetical protein |
| 2106 | hypothetical protein |
| 2107 | hypothetical protein |
| 2108 | Exonuclease SbcC |
| 2109 | Exonuclease SbcD |
| 2110 | hypothetical protein |
| 2111 | FIG00506729: hypothetical protein |
| 2112 | Adenylylsulfate kinase (EC 2.7.1.25) |
| 2113 | hypothetical protein |
| 2114 | probable hydrolase |
| 2115 | hypothetical protein |
| 2116 | transcriptional regulator, AraC family |
| 2117 | PPE-repeat proteins |
| 2118 | TldD protein, part of proposed TldE/TldD proteolytic complex (PMID 12029038) |
| 2119 | Omega amidase (Nit2 homolog) |

TABLE 19-continued

| SEQ ID NO. | function |
|---|---|
| 2120 | FIG005080: Possible exported protein |
| 2121 | Glutamate-ammonia-ligase adenylyltransferase (EC 2.7.7.42) |
| 2122 | Branched-chain amino acid aminotransferase (EC 2.6.1.42) |
| 2123 | hypothetical protein |
| 2124 | ADP-heptose--lipooligosaccharide heptosyltransferase II (EC 2.4.1.—) |
| 2125 | Transcriptional regulator, TetR family |
| 2126 | hypothetical protein |
| 2127 | probable ATP-dependent RNA helicase |
| 2128 | Acetyl-CoA C-acyltransferase (EC 2.3.1.16) @ Acetyl-CoA acetyltransferase (EC 2.3.1.9) |
| 2129 | Predicted transcriptional regulator LiuR of leucine degradation pathway, MerR family |
| 2130 | 3-hydroxybutyryl-CoA dehydrogenase (EC 1.1.1.157) |
| 2131 | Methylmalonate-semialdehyde dehydrogenase (EC 1.2.1.27) |
| 2132 | Branched-chain acyl-CoA dehydrogenase (EC 1.3.99.12) |
| 2133 | Enoyl-CoA hydratase [valine degradation] (EC 4.2.1.17) |
| 2134 | 3-hydroxyisobutyryl-CoA hydrolase (EC 3.1.2.4) |
| 2135 | 3-hydroxyisobutyrate dehydrogenase (EC 1.1.1.31) |
| 2136 | FIG01213271: hypothetical protein |
| 2137 | membrane protein, putative |
| 2138 | Probable GTPase related to EngC |
| 2139 | hypothetical protein |
| 2140 | hypothetical protein |
| 2141 | oxidoreductase, FAD-binding, putative |
| 2142 | hypothetical protein |
| 2143 | hypothetical protein |
| 2144 | Histone acetyltransferase HPA2 and related acetyltransferases |
| 2145 | hypothetical protein |
| 2146 | hypothetical protein |
| 2147 | Beta N-acetyl-glucosaminidase (EC 3.2.1.52) |
| 2148 | Holo-[acyl-carrier protein] synthase (EC 2.7.8.7) |
| 2149 | putative membrane protein |
| 2150 | Pyridoxine 5'-phosphate synthase (EC 2.6.99.2) |
| 2151 | DNA recombination and repair protein RecO |
| 2152 | hypothetical protein |
| 2153 | GTP-binding protein Era |
| 2154 | Ribonuclease III (EC 3.1.26.3) |
| 2155 | hypothetical protein |
| 2156 | Signal peptidase I (EC 3.4.21.89) |
| 2157 | Translation elongation factor LepA |
| 2158 | probable thioredoxin NMA0966 |
| 2159 | Sigma factor RpoE negative regulatory protein RseB precursor |
| 2160 | hypothetical protein |
| 2161 | RNA polymerase sigma factor RpoE |
| 2162 | Methylisocitrate lyase (EC 4.1.3.30) |
| 2163 | 2-methylcitrate synthase (EC 2.3.3.5) |
| 2164 | protein of unknown function DUF1089 |
| 2165 | 2-methylcitrate dehydratase FeS dependent (EC 4.2.1.79) |
| 2166 | 2-methylaconitate isomerase |
| 2167 | hypothetical protein |
| 2168 | Threonine dehydrogenase and related Zn-dependent dehydrogenases |
| 2169 | Permease of the drug/metabolite transporter (DMT) superfamily |
| 2170 | Response regulator containing a CheY-like receiver domain and a GGDEF domain |
| 2171 | putative Cytochrome bd2, subunit I |
| 2172 | putative Cytochrome bd2, subunit II |
| 2173 | hypothetical protein |
| 2174 | probable membrane protein STY1534 |
| 2175 | Molybdenum cofactor biosynthesis protein MoaA |
| 2176 | Transcriptional regulator |
| 2177 | Cytochrome d ubiquinol oxidase subunit II (EC 1.10.3.—) |
| 2178 | Cytochrome d ubiquinol oxidase subunit I (EC 1.10.3.—) |
| 2179 | Putative formate dehydrogenase oxidoreductase protein |
| 2180 | Transcriptional regulator, GntR family domain/Aspartate aminotransferase (EC 2.6.1.1) |
| 2181 | Dihydrodipicolinate synthase (EC 4.2.1.52) |
| 2182 | hypothetical protein |
| 2183 | L-lysine permease |
| 2184 | hypothetical protein |
| 2185 | hypothetical protein |
| 2186 | hypothetical protein |
| 2187 | hypothetical protein |
| 2188 | hypothetical protein |
| 2189 | hypothetical protein |
| 2190 | hypothetical protein |
| 2191 | Permease of the drug/metabolite transporter (DMT) superfamily |
| 2192 | Argininosuccinate synthase (EC 6.3.4.5) |
| 2193 | Ornithine carbamoyltransferase (EC 2.1.3.3) |
| 2194 | Arginine decarboxylase (EC 4.1.1.19); Lysine decarboxylase (EC 4.1.1.18); Ornithine decarboxylase (EC 4.1.1.17) |

TABLE 19-continued

| SEQ ID NO. | function |
| --- | --- |
| 2195 | ATP-dependent helicase DinG/Rad3 |
| 2196 | PhnO-related protein |
| 2197 | probable porin protein |
| 2198 | Endonuclease I precursor (EC 3.1.21.1) |
| 2199 | Metallopeptidase |
| 2200 | Biopolymer transport protein ExbD/TolR |
| 2201 | Biopolymer transport protein ExbD/TolR |
| 2202 | MotA/TolQ/ExbB proton channel family protein |
| 2203 | Periplasmic protein TonB, links inner and outer membranes |
| 2204 | TonB-dependent receptor |
| 2205 | Dipeptide transport ATP-binding protein DppD (TC 3.A.1.5.2) |
| 2206 | Oligopeptide transport system permease protein OppC (TC 3.A.1.5.1) |
| 2207 | minor tail protein L |
| 2208 | Phage tail assembly protein #Phage tail assembly protein K |
| 2209 | prophage LambdaSo, tail assembly protein I |
| 2210 | COG4733: Phage-related protein, tail component |
| 2211 | hypothetical protein |
| 2212 | hypothetical protein |
| 2213 | hypothetical protein |
| 2214 | hypothetical protein |
| 2215 | hypothetical protein |
| 2216 | hypothetical protein |
| 2217 | hypothetical protein |
| 2218 | hypothetical protein |
| 2219 | hypothetical protein |
| 2220 | Error-prone, lesion bypass DNA polymerase V (UmuC) |
| 2221 | Error-prone repair protein UmuD |
| 2222 | phosphatidylserine/phosphatidylglycerophosphate/cardiolipin synthases and related enzymes-like protein |
| 2223 | hypothetical protein |
| 2224 | hypothetical protein |
| 2225 | hypothetical protein |
| 2226 | Cobyrinic acid a,c-diamide synthase |
| 2227 | hypothetical protein |
| 2228 | hypothetical protein |
| 2229 | hypothetical protein |
| 2230 | hypothetical protein |
| 2231 | TonB-dependent receptor |
| 2232 | Enterobactin esterase |
| 2233 | putative MbtH family protein |
| 2234 | Enterobactin synthetase component F, serine activating enzyme (EC 2.7.7.—) |
| 2235 | hypothetical protein |
| 2236 | Ferric enterobactin transport ATP-binding protein FepC (TC 3.A.1.14.2) @ ABC-type Fe3+-siderophore transport system, ATPase component |
| 2237 | Ferric enterobactin transport system permease protein FepG (TC 3.A.1.14.2) @ ABC-type Fe3+-siderophore transport system, permease 2 component |
| 2238 | Ferric enterobactin transport system permease protein FepD (TC 3.A.1.14.2) @ ABC-type Fe3+-siderophore transport system, permease component |
| 2239 | Enterobactin exporter EntS |
| 2240 | Ferric enterobactin-binding periplasmic protein FepB (TC 3.A.1.14.2) |
| 2241 | RND efflux system, membrane fusion protein CmeA |
| 2242 | RND efflux system, inner membrane transporter CmeB |
| 2243 | RND efflux system, outer membrane lipoprotein CmeC |
| 2244 | Lipase precursor (EC 3.1.1.3) |
| 2245 | lipase chaperone |
| 2246 | Indole-3-glycerol phosphate synthase (EC 4.1.1.48) |
| 2247 | 3-oxoacyl-[acyl-carrier protein] reductase (EC 1.1.1.100) |
| 2248 | LysR family transcriptional regulator PA2877 |
| 2249 | FIG042921: similarity to aminoacyl-tRNA editing enzymes YbaK, ProX |
| 2250 | Transcriptional regulator, TetR family |
| 2251 | COGs COG3558 |
| 2252 | TldD family protein, Beta/Gamma-proteobacterial subgroup |
| 2253 | TldE/PmbA family protein, Beta/Gamma-proteobacterial subgroup |
| 2254 | hypothetical protein |
| 2255 | Aminoacyl-histidine dipeptidase (Peptidase D) (EC 3.4.13.3) |
| 2256 | hypothetical protein |
| 2257 | 1-deoxy-D-xylulose 5-phosphate synthase (EC 2.2.1.7) |
| 2258 | Octaprenyl diphosphate synthase (EC 2.5.1.90)/Dimethylallyltransferase (EC 2.5.1.1)/(2E,6E)-farnesyl diphosphate synthase (EC 2.5.1.10)/Geranylgeranyl diphosphate synthase (EC 2.5.1.29) |
| 2259 | Exodeoxyribonuclease VII small subunit (EC 3.1.11.6) |
| 2260 | hypothetical protein |
| 2261 | Putative NAD(P)-dependent oxidoreductase EC-YbbO |
| 2262 | Dipeptide-binding ABC transporter, periplasmic substrate-binding component (TC 3.A.1.5.2) |
| 2263 | Dipeptide transport system permease protein DppB (TC 3.A.1.5.2) |

TABLE 19-continued

| SEQ ID NO. | function |
|---|---|
| 2264 | Oligopeptide transport system permease protein OppC (TC 3.A.1.5.1) |
| 2265 | Dipeptide transport ATP-binding protein DppD (TC 3.A.1.5.2) |
| 2266 | hypothetical protein |
| 2267 | Glucose-methanol-choline (GMC) oxidoreductase:NAD binding site |
| 2268 | hypothetical protein |
| 2269 | Probable RNA methyltransferase PA1839 |
| 2270 | hypothetical protein |
| 2271 | unnamed protein product; Some similarities with probable aminopeptidase |
| 2272 | hypothetical protein |
| 2273 | Sodium/alanine symporter family protein |
| 2274 | Exonuclease, RNase T and DNA polymerase III |
| 2275 | hypothetical protein |
| 2276 | hypothetical protein |
| 2277 | hypothetical protein |
| 2278 | hypothetical protein |
| 2279 | hypothetical protein |
| 2280 | Mobile element protein |
| 2281 | GTP cyclohydrolase II (EC 3.5.4.25) |
| 2282 | hypothetical protein |
| 2283 | hypothetical protein |
| 2284 | probable microbial collagenase (EC: 3.4.24.3) |
| 2285 | 33 kDa chaperonin (Heat shock protein 33) (HSP33) |
| 2286 | hypothetical protein |
| 2287 | hypothetical protein |
| 2288 | 3-oxoacyl-(acyl carrier protein) synthase (EC 2.3.1.41) |
| 2289 | FIG036672: Nucleoside-diphosphate-sugar epimerase |
| 2290 | FIG003671: Metal-dependent hydrolase |
| 2291 | Adenylate-forming enzyme |
| 2292 | Ser/Thr and Tyr protein phosphatase (dual specificity) |
| 2293 | C-5 sterol desaturase (EC 1.3.—.—) |
| 2294 | probable linoleoyl-CoA desaturase (EC: 1.14.19.3) |
| 2295 | hypothetical protein |
| 2296 | Multi antimicrobial extrusion protein (Na(+)/drug antiporter), MATE family of MDR efflux pumps |
| 2297 | Transcription repressor of multidrug efflux pump acrAB operon, TetR (AcrR) family |
| 2298 | ABC transport system, permease component YbhR |
| 2299 | ABC transport system, permease component YbhS |
| 2300 | ABC transporter multidrug efflux pump, fused ATP-binding domains |
| 2301 | Predicted membrane fusion protein (MFP) component of efflux pump, membrane anchor protein YbhG |
| 2302 | Membrane-bound metal-dependent hydrolase YdjM, induced during SOS response |
| 2303 | hypothetical protein |
| 2304 | probable methyl-accepting chemotaxis protein |
| 2305 | Transcriptional regulator, PadR family |
| 2306 | iron-chelator utilization protein |
| 2307 | hypothetical protein |
| 2308 | hypothetical protein |
| 2309 | Prolyl-tRNA synthetase (EC 6.1.1.15), archaeal/eukaryal type |
| 2310 | hypothetical protein |
| 2311 | hypothetical protein |
| 2312 | conserved hypothetical protein |
| 2313 | hypothetical protein |
| 2314 | 2,4-dihydroxyhept-2-ene-1,7-dioic acid aldolase (EC 4.1.2.—) |
| 2315 | hypothetical protein |
| 2316 | hypothetical protein |
| 2317 | hypothetical protein |
| 2318 | hypothetical protein |
| 2319 | SPFH/band 7 domain protein |
| 2320 | hypothetical protein |
| 2321 | hypothetical protein |
| 2322 | Phosphoribosylformylglycinamidine synthase, synthetase subunit (EC 6.3.5.3)/ Phosphoribosylformylglycinamidine synthase, glutamine amidotransferase subunit (EC 6.3.5.3) |
| 2323 | Nitrogen regulatory protein P-II |
| 2324 | Probable component of the lipoprotein assembly complex (forms a complex with YaeT, YfgL, and NlpB) |
| 2325 | Ribosomal large subunit pseudouridine synthase D (EC 4.2.1.70) |
| 2326 | COG1496: Uncharacterized conserved protein |
| 2327 | ThiJ/PfpI family protein |
| 2328 | hypothetical protein |
| 2329 | metal-dependent phosphohydrolase |
| 2330 | Ren protein |
| 2331 | hypothetical protein |
| 2332 | Prolyl endopeptidase (EC 3.4.21.26) |
| 2333 | hypothetical protein |
| 2334 | Lipid A export ATP-binding/permease protein MsbA |

TABLE 19-continued

| SEQ ID NO. | function |
|---|---|
| 2335 | ApaG protein |
| 2336 | Ribulose-phosphate 3-epimerase (EC 5.1.3.1) |
| 2337 | short chain dehydrogenase |
| 2338 | Phosphoglycolate phosphatase (EC 3.1.3.18) |
| 2339 | Anthranilate synthase, aminase component (EC 4.1.3.27) |
| 2340 | hypothetical protein |
| 2341 | hypothetical protein |
| 2342 | Methyltransferase Sare_0198 |
| 2343 | Ribonucleotide reductase of class Ia (aerobic), alpha subunit (EC 1.17.4.1) |
| 2344 | Long-chain-fatty-acid--CoA ligase (EC 6.2.1.3) |
| 2345 | Long-chain-fatty-acid--CoA ligase (EC 6.2.1.3) |
| 2346 | Long-chain-fatty-acid--CoA ligase (EC 6.2.1.3) |
| 2347 | hypothetical protein |
| 2348 | Shufflon-specific DNA recombinase |
| 2349 | transcriptional regulator, XRE family |
| 2350 | Lytic transglycosylase, catalytic |
| 2351 | hypothetical protein |
| 2352 | hypothetical protein |
| 2353 | cell wall endopeptidase, family M23/M37 |
| 2354 | hypothetical protein |
| 2355 | hypothetical protein |
| 2356 | hypothetical protein |
| 2357 | diguanylate cyclase/phosphodiesterase (GGDEF & EAL domains) with PAS/PAC sensor(s) |
| 2358 | hypothetical protein |
| 2359 | Leader peptidase (Prepilin peptidase) (EC 3.4.23.43)/N-methyltransferase (EC 2.1.1.—) |
| 2360 | hypothetical protein |
| 2361 | hypothetical protein |
| 2362 | protein of unknown function DUF583 |
| 2363 | hypothetical protein |
| 2364 | Antirestriction protein |
| 2365 | hypothetical protein |
| 2366 | hypothetical protein |
| 2367 | Malate Na(+) symporter |
| 2368 | 3-isopropylmalate dehydratase small subunit (EC 4.2.1.33) |
| 2369 | 3-isopropylmalate dehydratase large subunit (EC 4.2.1.33) |
| 2370 | Transcriptional regulator, LysR family |
| 2371 | Hypothetical adenine-specific methylase yfcB |
| 2372 | Phosphomannomutase (EC 5.4.2.8)/Phosphoglucomutase (EC 5.4.2.2) |
| 2373 | Anthranilate phosphoribosyltransferase (EC 2.4.2.18) |
| 2374 | hypothetical protein |
| 2375 | Anthranilate synthase, amidotransferase component (EC 4.1.3.27) @ Para- |
| 2376 | aminobenzoate synthase, amidotransferase component (EC 2.6.1.85) hypothetical protein |
| 2377 | Serine phosphatase RsbU, regulator of sigma subunit |
| 2378 | NADH-ubiquinone oxidoreductase chain B (EC 1.6.5.3) homolog; Hypothetical oxidoreductase |
| 2379 | Transcriptional regulator, AraC family |
| 2380 | hypothetical protein |
| 2381 | hypothetical protein |
| 2382 | Phenylacetic acid degradation protein paaA |
| 2383 | hypothetical protein |
| 2384 | tRNA-Leu-TAG |
| 2385 | Putative TEGT family carrier/transport protein |
| 2386 | hypothetical protein |
| 2387 | hypothetical protein |
| 2388 | hypothetical protein |
| 2389 | hypothetical protein |
| 2390 | hypothetical protein |
| 2391 | hypothetical protein |
| 2392 | protein of unknown function DUF882 |
| 2393 | hypothetical protein |
| 2394 | hypothetical protein |
| 2395 | 2-Keto-3-deoxy-D-manno-octulosonate-8-phosphate synthase (EC 2.5.1.55) |
| 2396 | hypothetical protein |
| 2397 | Glutathione S-transferase (EC 2.5.1.18) |
| 2398 | hypothetical protein |
| 2399 | FIG00506651: hypothetical protein |
| 2400 | hypothetical protein |
| 2401 | Putative 2-component regulator |
| 2402 | Putative peptidoglycan hydrolase YvbX, NOT involved in spore germination |
| 2403 | RND efflux system, outer membrane lipoprotein, NodT family |
| 2404 | Cobalt-zinc-cadmium resistance protein CzcA; Cation efflux system protein CusA |
| 2405 | Cobalt-zinc-cadmium resistance protein CzcA; Cation efflux system protein CusA |
| 2406 | Probable RND efflux membrane fusion protein |
| 2407 | hypothetical protein |
| 2408 | Lysine-specific permease |

TABLE 19-continued

| SEQ ID NO. | function |
|---|---|
| 2409 | hypothetical protein |
| 2410 | probable multiple antibiotic resistance protein MarC |
| 2411 | Alcohol dehydrogenase (EC 1.1.1.1) |
| 2412 | O-acetylhomoserine sulfhydrylase (EC 2.5.1.49) |
| 2413 | Predicted transcriptional regulator for fatty acid degradation FadQ, TetR family |
| 2414 | Butyryl-CoA dehydrogenase (EC 1.3.99.2) |
| 2415 | Thioesterase superfamily |
| 2416 | Long-chain fatty acid transport protein |
| 2417 | Enoyl-CoA hydratase (EC 4.2.1.17)/3,2-trans-enoyl-CoA isomerase (EC 5.3.3.8)/3-hydroxyacyl-CoA dehydrogenase (EC 1.1.1.35) |
| 2418 | hypothetical protein |
| 2419 | 3-ketoacyl-CoA thiolase (EC 2.3.1.16) @ Acetyl-CoA acetyltransferase (EC 2.3.1.9) |
| 2420 | hypothetical protein |
| 2421 | probable methyl-accepting chemotaxis protein |
| 2422 | hypothetical protein |
| 2423 | hypothetical protein |
| 2424 | hypothetical protein |
| 2425 | hypothetical protein |
| 2426 | probable phage-related lysozyme (EC: 3.2.1.17) |
| 2427 | hypothetical protein |
| 2428 | FIG00460797: hypothetical protein |
| 2429 | hypothetical protein |
| 2430 | probable tail fiber assembly protein |
| 2431 | Bacteriophage tail fiber protein |
| 2432 | FIG121501: Prophage tail protein |
| 2433 | Phage FluMu protein gp47 |
| 2434 | Bacteriophage protein GP46 |
| 2435 | Putative baseplate assembly protein Gp45, Mu-like |
| 2436 | FIG003269: Prophage tail protein |
| 2437 | hypothetical protein |
| 2438 | hypothetical protein |
| 2439 | hypothetical protein |
| 2440 | hypothetical protein |
| 2441 | hypothetical protein |
| 2442 | hypothetical protein |
| 2443 | hypothetical protein |
| 2444 | hypothetical protein |
| 2445 | conserved hypothetical protein |
| 2446 | Bacteriophage tail sheath protein |
| 2447 | hypothetical protein |
| 2448 | hypothetical protein |
| 2449 | hypothetical protein |
| 2450 | elements of external origin; phage-related functions and prophages |
| 2451 | hypothetical protein |
| 2452 | hypothetical protein |
| 2453 | Head-tail preconnector protein GP5 |
| 2454 | Phage portal |
| 2455 | hypothetical protein |
| 2456 | Phage terminase, large subunit |
| 2457 | hypothetical protein |
| 2458 | hypothetical protein |
| 2459 | hypothetical protein |
| 2460 | hypothetical protein |
| 2461 | hypothetical protein |
| 2462 | hypothetical protein |
| 2463 | COG4570: Holliday junction resolvase |
| 2464 | hypothetical protein |
| 2465 | hypothetical protein |
| 2466 | hypothetical protein |
| 2467 | hypothetical protein |
| 2468 | hypothetical protein |
| 2469 | hypothetical protein |
| 2470 | hypothetical protein |
| 2471 | hypothetical protein |
| 2472 | hypothetical protein |
| 2473 | hypothetical protein |
| 2474 | hypothetical protein |
| 2475 | hypothetical protein |
| 2476 | hypothetical protein |
| 2477 | hypothetical protein |
| 2478 | Phage-related protein predicted endonuclease-like |
| 2479 | RecT protein |
| 2480 | DNA recombination-dependent growth factor C |
| 2481 | hypothetical protein |
| 2482 | hypothetical protein |
| 2483 | hypothetical protein |

TABLE 19-continued

| SEQ ID NO. | function |
|---|---|
| 2484 | hypothetical protein |
| 2485 | hypothetical protein |
| 2486 | hypothetical protein |
| 2487 | Putative methyltransferase |
| 2488 | hypothetical protein |
| 2489 | hypothetical protein |
| 2490 | hypothetical protein |
| 2491 | tRNA-Ser-TGA |
| 2492 | DNA repair protein RecN |
| 2493 | NAD kinase (EC 2.7.1.23) |
| 2494 | regulatory protein, LuxR:Response regulator receiver |
| 2495 | hypothetical protein |
| 2496 | Peptide methionine sulfoxide reductase MsrA (EC 1.8.4.11) |
| 2497 | Deacetylases, including yeast histone deacetylase and acetoin utilization protein |
| 2498 | hypothetical protein |
| 2499 | probable acetyltransferase |
| 2500 | tRNA-dihydrouridine synthase C (EC 1.—.—.—) |
| 2501 | Potassium efflux system KefA protein/Small-conductance mechanosensitive channel |
| 2502 | hypothetical protein |
| 2503 | Error-prone repair protein UmuD |
| 2504 | hypothetical protein |
| 2505 | Methionine aminopeptidase (EC 3.4.11.18) |
| 2506 | Transcriptional regulator, DeoR family |
| 2507 | ThiJ/PfpI family protein |
| 2508 | Histone acetyltransferase HPA2 and related acetyltransferases |
| 2509 | Histone acetyltransferase HPA2 and related acetyltransferases |
| 2510 | GCN5-related N-acetyltransferase |
| 2511 | Inner membrane protein |
| 2512 | probable alpha helix chain yaiN |
| 2513 | hypothetical protein |
| 2514 | hypothetical protein |
| 2515 | Transcriptional regulator, MarR family |
| 2516 | putative monooxygenase |
| 2517 | Thiol:disulfide interchange protein DsbG precursor |
| 2518 | hypothetical protein |
| 2519 | Thymidine kinase (EC 2.7.1.21) |
| 2520 | hypothetical protein |
| 2521 | Nitroreductase family protein |
| 2522 | Protein involved in catabolism of external DNA |
| 2523 | tRNA pseudouridine synthase C (EC 4.2.1.70) |
| 2524 | Predicted nucleoside ABC transporter, substrate-binding component |
| 2525 | Predicted nucleoside ABC transporter, ATP-binding component |
| 2526 | Predicted nucleoside ABC transporter, permease 1 component |
| 2527 | Predicted nucleoside ABC transporter, permease 2 component |
| 2528 | Molybdopterin biosynthesis protein MoeA |
| 2529 | Ferredoxin, 2Fe—2S |
| 2530 | Putative membrane protein |
| 2531 | Cytochrome c-type biogenesis protein DsbD, protein-disulfide reductase (EC 1.8.1.8) |
| 2532 | hypothetical protein |
| 2533 | Chorismate mutase I (EC 5.4.99.5)/Prephenate dehydratase (EC 4.2.1.51) |
| 2534 | hypothetical protein |
| 2535 | hypothetical protein |
| 2536 | Hypothetical protein VC0266 (sugar utilization related?) |
| 2537 | Enoyl-[acyl-carrier-protein] reductase [FMN] (EC 1.3.1.9) |
| 2538 | GTP cyclohydrolase I (EC 3.5.4.16) type 1 |
| 2539 | hypothetical protein |
| 2540 | peptidylprolyl isomerase, FKBP-type (EC: 5.2.1.8) |
| 2541 | FIG00506354: hypothetical protein |
| 2542 | Acetoacetyl-CoA reductase (EC 1.1.1.36) |
| 2543 | Ribosome small subunit-stimulated GTPase EngC |
| 2544 | Pterin-4-alpha-carbinolamine dehydratase (EC 4.2.1.96) |
| 2545 | macromolecule metabolism; macromolecule degradation; degradation of proteins, peptides, glycopeptides |
| 2546 | 3'-to-5' oligoribonuclease (orn) |
| 2547 | Glucose-6-phosphate isomerase (EC 5.3.1.9) |
| 2548 | C-terminal domain of CinA type S |
| 2549 | FIG00537892: hypothetical protein |
| 2550 | Tyrosine recombinase XerC |
| 2551 | MoxR-like ATPases |
| 2552 | hypothetical protein |
| 2553 | hypothetical protein |
| 2554 | Universal stress protein (Usp) |
| 2555 | hypothetical protein |
| 2556 | Acetylornithine deacetylase (EC 3.5.1.16) |
| 2557 | Probable sodium-dependent transporter |
| 2558 | hypothetical protein |

TABLE 19-continued

| SEQ ID NO. | function |
|---|---|
| 2559 | Biosynthetic Aromatic amino acid aminotransferase alpha (EC 2.6.1.57) @ Aromatic-amino-acid aminotransferase (EC 2.6.1.57) |
| 2560 | hypothetical protein |
| 2561 | Transcriptional regulator, TetR family |
| 2562 | probable integral membrane protein |
| 2563 | Peptide chain release factor 3 |
| 2564 | hypothetical protein |
| 2565 | hypothetical protein |
| 2566 | Riboflavin synthase eubacterial/eukaryotic (EC 2.5.1.9) |
| 2567 | conserved hypothetical protein [*Pyrococcus horikoshii*]; COG2102: Predicted ATPases of PP-loop superfamily; IPR002761: Domain of unknown function DUF71 |
| 2568 | 3,4-dihydroxy-2-butanone 4-phosphate synthase (EC 4.1.99.12)/GTP cyclohydrolase II (EC 3.5.4.25) |
| 2569 | 6,7-dimethyl-8-ribityllumazine synthase (EC 2.5.1.78) |
| 2570 | Transcription termination protein NusB |
| 2571 | Thiamine-monophosphate kinase (EC 2.7.4.16) |
| 2572 | Phosphatidylglycerophosphatase A (EC 3.1.3.27) |
| 2573 | Cell division protein FtsK |
| 2574 | HYPOTHETICAL SIGNAL PEPTIDE PROTEIN |
| 2575 | hypothetical protein |
| 2576 | hypothetical protein |
| 2577 | Aldehyde dehydrogenase (EC 1.2.1.3); Probable coniferyl aldehyde dehydrogenase (EC 1.2.1.68) |
| 2578 | FIG028932: hypothetical protein |
| 2579 | FIG022869: Oxidoreductase, GMC family |
| 2580 | hypothetical protein |
| 2581 | probable site-specific recombinase |
| 2582 | Transcriptional regulator, TetR family |
| 2583 | FIG00507944: hypothetical protein |
| 2584 | Enoyl-CoA hydratase (EC 4.2.1.17) |
| 2585 | Branched-chain amino acid ABC transporter, amino acid-binding protein (TC 3.A.1.4.1) |
| 2586 | Ferrochelatase, protoheme ferro-lyase (EC 4.99.1.1) |
| 2587 | Cell division protein FtsK |
| 2588 | hypothetical protein |
| 2589 | Anhydro-N-acetylmuramic acid kinase (EC 2.7.1.—) |
| 2590 | probable Peptidase |
| 2591 | Regulatory protein, RpfE type |
| 2592 | Single-stranded-DNA-specific exonuclease RecJ (EC 3.1.—.—) |
| 2593 | DNA recombination protein RmuC |
| 2594 | D-alanine--D-alanine ligase (EC 6.3.2.4) |
| 2595 | Predicted nucleoside ABC transporter, substrate-binding component |
| 2596 | hypothetical protein |
| 2597 | hypothetical protein |
| 2598 | Putative heat shock protein YegD |
| 2599 | probable integrase/recombinase protein |
| 2600 | radical SAM domain protein |
| 2601 | hypothetical protein |
| 2602 | hypothetical protein |
| 2603 | hypothetical protein |
| 2604 | hypothetical protein |
| 2605 | OrgB protein, associated with InvC ATPase of type III secretion system |
| 2606 | Oxygen-regulated invasion protein OrgA |
| 2607 | Type III secretion bridge between inner and outermembrane lipoprotein (YscJ, HrcJ, EscJ, PscJ) |
| 2608 | cell invasion protein - cytoplasmic |
| 2609 | Type III secretion cytoplasmic protein (YscF) |
| 2610 | Pathogenicity 1 island effector protein |
| 2611 | Invasion protein lagB precursor |
| 2612 | invasion genes transcription activator |
| 2613 | hypothetical protein |
| 2614 | hypothetical protein |
| 2615 | hypothetical protein |
| 2616 | hypothetical protein |
| 2617 | Type III secretion thermoregulatory protein (LcrF, VirF, transcription regulation of virulence plasmid) |
| 2618 | Type III secretion outermembrane pore forming protein (YscC, MxiD, HrcC, InvG) |
| 2619 | Type III secretion outermembrane contact sensing protein (YopN, Yop4b, LcrE) |
| 2620 | Type III secretion inner membrane channel protein (LcrD, HrcV, EscV, SsaV) |
| 2621 | Type III secretion system protein BsaR; Surface presentation of antigens protein SpaK (Invasion protein InvB) |
| 2622 | Flagellum-specific ATP synthase FliI |
| 2623 | Surface presentation of antigens protein SpaM |
| 2624 | Type III secretion host injection and negative regulator protein (YopD); Surface presentation of antigens protein SpaN (Invasion protein InvJ) |
| 2625 | Type III secretion inner membrane protein (YscQ, homologous to flagellar export components) |

TABLE 19-continued

| SEQ ID NO. | function |
|---|---|
| 2626 | Type III secretion inner membrane protein (YscR, SpaR, HrcR, EscR, homologous to flagellar export components); Surface presentation of antigens protein SpaP |
| 2627 | Type III secretion inner membrane protein (YscS, homologous to flagellar export components); Surface presentation of antigens protein SpaQ |
| 2628 | Type III secretion inner membrane protein (YscT, HrcT, SpaR, EscT, EpaRI, homologous to flagellar export components) |
| 2629 | Type III secretion inner membrane protein (YscU, SpaS, EscU, HrcU, SsaU, homologous to flagellar export components) |
| 2630 | Type III secretion chaperone protein for YopD (SycD) |
| 2631 | cell invasion protein SipB |
| 2632 | Cell invasion protein sipC (Effector protein SipC) |
| 2633 | Cell invasion protein SipD (*Salmonella* invasion protein D) |
| 2634 | Type III secretion injected virulence protein (YopE) |
| 2635 | acyl carrier protein |
| 2636 | sensor protein evgS precursor (EC: 2.7.3.—) |
| 2637 | capsula synthesis response regulator transcription regulator protein |
| 2638 | ATP-binding region, ATPase-like |
| 2639 | two component transcriptional regulator, AraC family |
| 2640 | Cytochrome c family protein |
| 2641 | Lysine-epsilon oxidase (EC 1.4.3.20) antimicrobial protein LodA |
| 2642 | Dehydrogenase flavoprotein LodB |
| 2643 | Blue copper oxidase CueO precursor |
| 2644 | Tryptophan 2-monooxygenase (EC 1.13.12.3) |
| 2645 | Pyruvate decarboxylase (EC 4.1.1.1); Alpha-keto-acid decarboxylase (EC 4.1.1.—) |
| 2646 | Chromosome partition protein smc |
| 2647 | hypothetical protein |
| 2648 | tRNA pseudouridine synthase A (EC 4.2.1.70) |
| 2649 | hypothetical protein |
| 2650 | Glutathione S-transferase (EC 2.5.1.18) |
| 2651 | RNA:NAD 2'-phosphotransferase |
| 2652 | hypothetical protein |
| 2653 | Error-prone, lesion bypass DNA polymerase V (UmuC) |
| 2654 | Error-prone repair protein UmuD |
| 2655 | hypothetical protein |
| 2656 | Cytosine/purine/uracil/thiamine/allantoin permease family protein |
| 2657 | Endonuclease/Exonuclease/phosphatase family protein |
| 2658 | Methionine ABC transporter ATP-binding protein |
| 2659 | Methionine ABC transporter permease protein |
| 2660 | Methionine ABC transporter substrate-binding protein |
| 2661 | DNA gyrase subunit A (EC 5.99.1.3) |
| 2662 | FIG00506409: hypothetical protein |
| 2663 | hypothetical protein |
| 2664 | Phosphoserine aminotransferase (EC 2.6.1.52) |
| 2665 | hypothetical protein |
| 2666 | hypothetical protein |
| 2667 | Dipeptidyl aminopeptidases/acylaminoacyl-peptidases |
| 2668 | Muramoyltetrapeptide carboxypeptidase (EC 3.4.17.13) |
| 2669 | Flagellar hook-associated protein FliD |
| 2670 | Sulfate adenylyltransferase subunit 2 (EC 2.7.7.4) |
| 2671 | Sulfate adenylyltransferase subunit 1 (EC 2.7.7.4) |
| 2672 | Hypothetical Protein |
| 2673 | hypothetical protein |
| 2674 | hypothetical protein |
| 2675 | Zonula occludens toxin-like |
| 2676 | hypothetical protein |
| 2677 | hypothetical protein |
| 2678 | hypothetical protein |
| 2679 | Polyhydroxyalkanoic acid synthase |
| 2680 | Fatty acid desaturase (EC 1.14.19.1); Delta-9 fatty acid desaturase (EC 1.14.19.1) |
| 2681 | cAMP-binding proteins - catabolite gene activator and regulatory subunit of cAMP-dependent protein kinases |
| 2682 | Aconitate hydratase (EC 4.2.1.3) |
| 2683 | Aconitate hydratase 2 (EC 4.2.1.3) |
| 2684 | Transcriptional regulatory protein |
| 2685 | hypothetical protein |
| 2686 | Fructose-1,6-bisphosphatase, type I (EC 3.1.3.11) |
| 2687 | Threonine efflux protein |
| 2688 | Methionine aminopeptidase (EC 3.4.11.18) |
| 2689 | Flagellin protein FlaA |
| 2690 | Regulator of nucleoside diphosphate kinase |
| 2691 | Pole remodelling regulatory diguanylate cyclase |
| 2692 | Signal transduction histidine kinase |
| 2693 | Hydrolase (HAD superfamily) |
| 2694 | Alpha/beta hydrolase |
| 2695 | Ferredoxin |
| 2696 | Replicative DNA helicase (EC 3.6.1.—) |

TABLE 19-continued

| SEQ ID NO. | function |
|---|---|
| 2697 | NAD(FAD)-utilizing dehydrogenases |
| 2698 | Superoxide dismutase [Fe] (EC 1.15.1.1) |
| 2699 | probable two-component response regulator |
| 2700 | Chemotaxis response regulator protein-glutamate methylesterase CheB (EC 3.1.1.61) |
| 2701 | Chemotaxis protein methyltransferase CheR (EC 2.1.1.80) |
| 2702 | Positive regulator of CheA protein activity (CheW) |
| 2703 | Methyl-accepting chemotaxis protein I (serine chemoreceptor protein) |
| 2704 | Signal transduction histidine kinase CheA (EC 2.7.3.—) |
| 2705 | hypothetical protein |
| 2706 | Chemotaxis regulator - transmits chemoreceptor signals to flagelllar motor components CheY |
| 2707 | Methyl-accepting chemotaxis protein |
| 2708 | probable amino acid ABC transporter, periplasmic amino acid-binding protein |
| 2709 | Amidophosphoribosyltransferase (EC 2.4.2.14) |
| 2710 | Colicin V production protein |
| 2711 | DedD protein |
| 2712 | Dihydrofolate synthase (EC 6.3.2.12)/Folylpolyglutamate synthase (EC 6.3.2.17) |
| 2713 | hypothetical protein |
| 2714 | FIG00847214: hypothetical protein |
| 2715 | COG0488: ATPase components of ABC transporters with duplicated ATPase domains |
| 2716 | probable amino acid ABC transporter |
| 2717 | ABC-type sugar transport system, periplasmic component |
| 2718 | probable lipoprotein |
| 2719 | Diaminopimelate epimerase (EC 5.1.1.7) |
| 2720 | Protein of unknown function DUF484 |
| 2721 | hypothetical protein |
| 2722 | probable transmembrane protein |
| 2723 | hypothetical protein |
| 2724 | protein of unknown function DUF330 |
| 2725 | Paraquat-inducible protein B |
| 2726 | Paraquat-inducible protein A |
| 2727 | Paraquat-inducible protein A |
| 2728 | putative mitomycin resistance protein |
| 2729 | probable transmembrane protein |
| 2730 | probable transcriptional regulator LysR-family |
| 2731 | Peptidyl-prolyl cis-trans isomerase PpiD (EC 5.2.1.8) |
| 2732 | tRNA-Asp-GTC |
| 2733 | tRNA-Val-TAC |
| 2734 | DNA-binding protein HU-beta |
| 2735 | Cell division trigger factor (EC 5.2.1.8) |
| 2736 | hypothetical protein |
| 2737 | Large extracellular alpha-helical protein |
| 2738 | hypothetical protein |
| 2739 | Multimodular transpeptidase-transglycosylase (EC 2.4.1.129) (EC 3.4.—.—) |
| 2740 | hypothetical protein |
| 2741 | Microbial collagenase, secreted (EC 3.4.24.3) |
| 2742 | Oxidoreductase, short-chain dehydrogenase/reductase family |
| 2743 | Hydrogen peroxide-inducible genes activator |
| 2744 | TRANSPORTER, LysE family |
| 2745 | diguanylate cyclase/phosphodiesterase (GGDEF & EAL domains) with PAS/PAC sensor(s) |
| 2746 | Chromosome initiation inhibitor |
| 2747 | Cytidine deaminase (EC 3.5.4.5) |
| 2748 | Conserved domain protein |
| 2749 | Uncharacterized protein conserved in bacteria, NMA0228-like |
| 2750 | FIG01215019: hypothetical protein |
| 2751 | NAD(FAD)-utilizing dehydrogenase, sll0175 homolog |
| 2752 | hypothetical protein |
| 2753 | hypothetical protein |
| 2754 | probable response regulator |
| 2755 | hypothetical protein |
| 2756 | Signal transduction histidine kinase |
| 2757 | hypothetical protein |
| 2758 | G:T/U mismatch-specific uracil/thymine DNA-glycosylase |
| 2759 | Ribonuclease HII (EC 3.1.26.4) |
| 2760 | Lipid-A-disaccharide synthase (EC 2.4.1.182) |
| 2761 | Acyl-[acyl-carrier-protein]--UDP-N-acetylglucosamine O-acyltransferase (EC 2.3.1.129) |
| 2762 | (3R)-hydroxymyristoyl-[acyl carrier protein] dehydratase (EC 4.2.1.—) |
| 2763 | UDP-3-O-[3-hydroxymyristoyl] glucosamine N-acyltransferase (EC 2.3.1.—) |
| 2764 | Outer membrane protein H precursor |
| 2765 | Outer membrane protein assembly factor YaeT precursor |
| 2766 | hypothetical protein |
| 2767 | 1-deoxy-D-xylulose 5-phosphate reductoisomerase (EC 1.1.1.267) |
| 2768 | Phosphatidate cytidylyltransferase (EC 2.7.7.41) |
| 2769 | Undecaprenyl pyrophosphate synthetase (EC 2.5.1.31) (UPP synthetase) (Di-trans, poly-cis-decaprenylcistransferase) (Undecaprenyl diphosphate synthase) (UDS) |
| 2770 | Ribosome recycling factor |

TABLE 19-continued

| SEQ ID NO. | function |
| --- | --- |
| 2771 | Uridylate kinase (EC 2.7.4.—) |
| 2772 | Translation elongation factor Ts |
| 2773 | SSU ribosomal protein S2p (SAe) |
| 2774 | hypothetical protein |
| 2775 | Enoyl-[acyl-carrier-protein] reductase [FMN] (EC 1.3.1.9) |
| 2776 | probable transport transmembrane protein |
| 2777 | ABC-type amino acid transport/signal transduction systems, periplasmic component/domain |
| 2778 | Ribonucleotide reductase of class III (anaerobic), activating protein (EC 1.97.1.4) |
| 2779 | Ribonucleotide reductase of class III (anaerobic), large subunit (EC 1.17.4.2) |
| 2780 | hypothetical protein |
| 2781 | GTP-binding protein TypA/BipA |
| 2782 | hypothetical protein |
| 2783 | hypothetical protein |
| 2784 | FIG01074555: hypothetical protein |
| 2785 | Quinone oxidoreductase (EC 1.6.5.5) |
| 2786 | hypothetical protein |
| 2787 | FUPA27 P-type ATPase |
| 2788 | Type cbb3 cytochrome oxidase biogenesis protein CcoS, involved in heme b insertion |
| 2789 | hypothetical protein |
| 2790 | Nucleoside permease NupC |
| 2791 | probable transporter |
| 2792 | hypothetical protein |
| 2793 | Dihydrolipoamide dehydrogenase (EC 1.8.1.4) |
| 2794 | Peroxiredoxin family protein/glutaredoxin |
| 2795 | FIG01280259: hypothetical protein |
| 2796 | hypothetical protein |
| 2797 | Soluble lytic murein transglycosylase precursor (EC 3.2.1.—) |
| 2798 | probable NADH-ubiquinone oxidoreductase (EC: 1.6.5.3) |
| 2799 | tRNA nucleotidyltransferase (EC 2.7.7.21) (EC 2.7.7.25) |
| 2800 | 2-methylaconitate isomerase |
| 2801 | 3-oxoacyl-[ACP] synthase |
| 2802 | FIG018329: 1-acyl-sn-glycerol-3-phosphate acyltransferase |
| 2803 | Acyl carrier protein (ACP1) |
| 2804 | Acyl carrier protein (ACP2) |
| 2805 | FIG017861: hypothetical protein |
| 2806 | FIGfam138462: Acyl-CoA synthetase, AMP-(fatty) acid ligase/(3R)-hydroxymyristoyl-[ACP] dehydratase (EC 4.2.1.—) |
| 2807 | FIG143263: Glycosyl transferase |
| 2808 | Lysophospholipid acyltransferase |
| 2809 | Putative histidine ammonia-lyase protein |
| 2810 | FIG002571: 4-hydroxybenzoyl-CoA thioesterase domain protein |
| 2811 | FIG027190: Putative transmembrane protein |
| 2812 | FIG021862: membrane protein, exporter |
| 2813 | SAM-dependent methyltransferase |
| 2814 | FIG035331: hypothetical protein |
| 2815 | 3-oxoacyl-[ACP] synthase (EC 2.3.1.41) FabV like |
| 2816 | 3-hydroxydecanoyl-[ACP] dehydratase (EC 4.2.1.60) |
| 2817 | 3-oxoacyl-[ACP] reductase (EC 1.1.1.100) |
| 2818 | F1G138576: 3-oxoacyl-[ACP] synthase (EC 2.3.1.41) |
| 2819 | Excinuclease ATPase subunit |
| 2820 | probable tRNA methyltransferase (EC: 2.1.1.33) |
| 2821 | hypothetical protein |
| 2822 | hypothetical protein |
| 2823 | Flagellar motor rotation protein MotB |
| 2824 | Flagellar motor rotation protein MotA |
| 2825 | Omega-amino acid--pyruvate aminotransferase (EC 2.6.1.18) |
| 2826 | Gamma-glutamyl-putrescine synthetase (EC 6.3.1.11) |
| 2827 | Gamma-glutamyl-GABA hydrolase (EC 3.5.1.94) |
| 2828 | Alanine dehydrogenase (EC 1.4.1.1) |
| 2829 | Putrescine utilization regulator |
| 2830 | Lactoylglutathione lyase (EC 4.4.1.5) |
| 2831 | Gamma-glutamyl-aminobutyraldehyde dehydrogenase (EC 1.2.1.—) |
| 2832 | hypothetical protein |
| 2833 | hypothetical protein |
| 2834 | hypothetical protein |
| 2835 | FMN-dependent NADH-azoreductase |
| 2836 | Transcriptional regulator, LysR family |
| 2837 | Histone acetyltransferase HPA2 and related acetyltransferases |
| 2838 | INTRACELLULAR PHB DEPOLYMERASE |
| 2839 | putative membrane protein |
| 2840 | hypothetical protein |
| 2841 | VgrG protein |
| 2842 | hypothetical protein |
| 2843 | Oligopeptide transport system permease protein OppC (TC 3.A.1.5.1) |
| 2844 | Dipeptide transport ATP-binding protein DppD (TC 3.A.1.5.2) |

TABLE 19-continued

| SEQ ID NO. | function |
|---|---|
| 2845 | hypothetical protein |
| 2846 | hypothetical protein |
| 2847 | LysR-family transcriptional regulator STM3020 |
| 2848 | hypothetical protein |
| 2849 | Ethidium bromide-methyl viologen resistance protein EmrE |
| 2850 | Cellulose synthase, putative |
| 2851 | Cellulose synthase catalytic subunit [UDP-forming] (EC 2.4.1.12) |
| 2852 | Cyclic di-GMP binding protein precursor |
| 2853 | Endoglucanase precursor (EC 3.2.1.4) |
| 2854 | Cellulose synthase operon protein C |
| 2855 | hypothetical protein |
| 2856 | FIG002337: predicted inner membrane protein |
| 2857 | hypothetical protein |
| 2858 | hypothetical protein |
| 2859 | hypothetical protein |
| 2860 | hypothetical protein |
| 2861 | Exoenzymes regulatory protein AepA in lipid-linked oligosaccharide synthesis cluster |
| 2862 | Valyl-tRNA synthetase (EC 6.1.1.9) |
| 2863 | hypothetical protein |
| 2864 | calcium/proton antiporter |
| 2865 | 2-polyprenyl-6-methoxyphenol hydroxylase and related FAD-dependent oxidoreductases |
| 2866 | hypothetical protein |
| 2867 | hypothetical protein |
| 2868 | hypothetical protein |
| 2869 | hypothetical protein |
| 2870 | hypothetical protein |
| 2871 | hypothetical protein |
| 2872 | probable Rhs-family protein |
| 2873 | putative transcriptional regulator, Fis family protein |
| 2874 | Mobile element protein |
| 2875 | tRNA-Arg-CCT |
| 2876 | hypothetical protein |
| 2877 | hypothetical protein |
| 2878 | Putative phage tail core protein |
| 2879 | Phage tail sheath monomer |
| 2880 | hypothetical protein |
| 2881 | hypothetical protein |
| 2882 | hypothetical protein |
| 2883 | hypothetical protein |
| 2884 | hypothetical protein |
| 2885 | hypothetical protein |
| 2886 | hypothetical protein |
| 2887 | DNA polymerase III alpha subunit (EC 2.7.7.7) |
| 2888 | hypothetical protein |
| 2889 | Hypothetical protein YaeJ with similarity to translation release factor |
| 2890 | probable chemotaxis transducer, putative |
| 2891 | Disulphide-isomerase |
| 2892 | hypothetical protein |
| 2893 | OsmC/Ohr family protein |
| 2894 | YgjD/Kae1/Qri7 family, required for threonylcarbamoyladenosine (t(6)A) formation in tRNA |
| 2895 | Glutathione-regulated potassium-efflux system ATP-binding protein |
| 2896 | Acetyl-coenzyme A carboxyl transferase beta chain (EC 6.4.1.2) |
| 2897 | Tryptophan synthase alpha chain (EC 4.2.1.20) |
| 2898 | Tryptophan synthase beta chain (EC 4.2.1.20) |
| 2899 | Phosphoribosylanthranilate isomerase (EC 5.3.1.24) |
| 2900 | tRNA pseudouridine synthase A (EC 4.2.1.70) |
| 2901 | probable transmembrane protein |
| 2902 | hypothetical protein |
| 2903 | hypothetical protein |
| 2904 | Aspartate-semialdehyde dehydrogenase (EC 1.2.1.11) |
| 2905 | Aspartate-semialdehyde dehydrogenase (EC 1.2.1.11) |
| 2906 | FAD dependent oxidoreductase |
| 2907 | Tryptophan 2-monooxygenase (EC 1.13.12.3) |
| 2908 | hypothetical protein |
| 2909 | 3-isopropylmalate dehydrogenase (EC 1.1.1.85) |
| 2910 | hypothetical protein |
| 2911 | hypothetical protein |
| 2912 | 3-isopropylmalate dehydratase small subunit (EC 4.2.1.33) |
| 2913 | hypothetical protein |
| 2914 | 3-isopropylmalate dehydratase large subunit (EC 4.2.1.33) |
| 2915 | putative DNA-binding protein |
| 2916 | hypothetical protein |
| 2917 | Nucleoside:H+ symporter:Major facilitator superfamily |

TABLE 19-continued

| SEQ ID NO. | function |
|---|---|
| 2918 | Ribosome-associated heat shock protein implicated in the recycling of the 50S subunit (S4 paralog) |
| 2919 | Fumarylacetoacetate hydrolase family protein |
| 2920 | Polyhydroxyalkanoic acid synthase |
| 2921 | 3-ketoacyl-CoA thiolase (EC 2.3.1.16) @ Acetyl-CoA acetyltransferase (EC 2.3.1.9) |
| 2922 | dTDP-4-dehydrorhamnose 3,5-epimerase (EC 5.1.3.13) |
| 2923 | Glucose-1-phosphate thymidylyltransferase (EC 2.7.7.24) |
| 2924 | dTDP-4-dehydrorhamnose reductase (EC 1.1.1.133) |
| 2925 | dTDP-glucose 4,6-dehydratase (EC 4.2.1.46) |
| 2926 | hypothetical protein |
| 2927 | Redox-sensitive transcriptional activator SoxR |
| 2928 | Multimeric flavodoxin WrbA |
| 2929 | hypothetical protein |
| 2930 | hypothetical protein |
| 2931 | Xaa-Pro aminopeptidase (EC 3.4.11.9) |
| 2932 | Transcriptional regulator, LysR family |
| 2933 | hypothetical protein |
| 2934 | hypothetical protein |
| 2935 | Transcriptional regulator, ArsR family |
| 2936 | Permeases of the major facilitator superfamily |
| 2937 | Penicillin-binding protein AmpH |
| 2938 | Chitooligosaccharide deacetylase (EC 3.5.1.—) |
| 2939 | probable oxidoreductase |
| 2940 | lipoprotein, putative |
| 2941 | hypothetical protein |
| 2942 | Thioredoxin reductase (EC 1.8.1.9) |
| 2943 | ortholog of *Bordetella pertussis* (BX470248) BP2475 |
| 2944 | Thiol peroxidase, Bcp-type (EC 1.11.1.15) |
| 2945 | Predicted ATPase related to phosphate starvation-inducible protein PhoH |
| 2946 | probable calcium binding hemolysin |
| 2947 | Probable glycosyltransferase |
| 2948 | hemolysin secretion protein D |
| 2949 | cyclolysin secretion ATP-binding protein |
| 2950 | Methionyl-tRNA formyltransferase (EC 2.1.2.9) |
| 2951 | Aminotransferase class-III |
| 2952 | hypothetical protein |
| 2953 | hypothetical protein |
| 2954 | hypothetical protein |
| 2955 | hypothetical protein |
| 2956 | Transcriptional regulator, MarR family |
| 2957 | Inner membrane component of tripartite multidrug resistance system |
| 2958 | protein of unknown function DUF1656 |
| 2959 | Membrane fusion component of tripartite multidrug resistance system |
| 2960 | Outer membrane component of tripartite multidrug resistance system |
| 2961 | hypothetical protein |
| 2962 | Ferredoxin |
| 2963 | NAD(FAD)-utilizing dehydrogenases |
| 2964 | probable methyl-accepting chemotaxis protein |
| 2965 | ATP-dependent 23S rRNA helicase DbpA |
| 2966 | Alpha-ketoglutarate-dependent taurine dioxygenase (EC 1.14.11.17) |
| 2967 | Taurine transport system permease protein TauC |
| 2968 | Taurine transport ATP-binding protein TauB |
| 2969 | Taurine-binding periplasmic protein TauA |
| 2970 | hypothetical protein |
| 2971 | hypothetical protein |
| 2972 | hypothetical protein |
| 2973 | Putative preQ0 transporter |
| 2974 | Ketosteroid isomerase-related protein |
| 2975 | hypothetical protein |
| 2976 | hypothetical protein |
| 2977 | Aquaporin Z |
| 2978 | probable transmembrane protein |
| 2979 | L-serine dehydratase (EC 4.3.1.17) |
| 2980 | acetyltransferase, GNAT family |
| 2981 | Biosynthetic arginine decarboxylase (EC 4.1.1.19) |
| 2982 | Succinylglutamate desuccinylase (EC 3.5.1.96) |
| 2983 | Flagellar hook-associated protein FlgL |
| 2984 | Flagellar hook-associated protein FlgK |
| 2985 | Flagellar protein FlgJ [peptidoglycan hydrolase] (EC 3.2.1.—) |
| 2986 | Flagellar P-ring protein FlgI |
| 2987 | Flagellar L-ring protein FlgH |
| 2988 | Flagellar basal-body rod protein FlgG |
| 2989 | Flagellar basal-body rod protein FlgF |
| 2990 | Flagellar hook protein FlgE |
| 2991 | Flagellar basal-body rod modification protein FlgD |
| 2992 | Flagellar basal-body rod protein FlgC |

TABLE 19-continued

| SEQ ID NO. | function |
|---|---|
| 2993 | Flagellar basal-body rod protein FlgB |
| 2994 | probable chemotaxis regulator protein |
| 2995 | hypothetical protein |
| 2996 | rtn like protein |
| 2997 | ATP-dependent RNA helicase NGO0650 |
| 2998 | hypothetical protein |
| 2999 | Glucosamine-link cellobiase (EC 3.2.1.21) |
| 3000 | NagC-like transcriptional regulator of glucosamine ABC transporter and kinase cluster |
| 3001 | N-acetylglucosamine kinase of eukaryotic type (EC 2.7.1.59) |
| 3002 | Sugar ABC transporter, periplasmic sugar-binding protein |
| 3003 | Chitobiose ABC transport system, permease protein 1 |
| 3004 | N-Acetyl-D-glucosamine ABC transport system, permease protein 2 |
| 3005 | L-Proline/Glycine betaine transporter ProP |
| 3006 | Inner membrane protein |
| 3007 | probable Na/H+ antiporter |
| 3008 | Putative cytoplasmic protein |
| 3009 | NADH pyrophosphatase (EC 3.6.1.22) |
| 3010 | hypothetical protein |
| 3011 | hypothetical protein |
| 3012 | hypothetical protein |
| 3013 | hypothetical protein |
| 3014 | tRNA-Thr-TGT |
| 3015 | Mobile element protein |
| 3016 | tRNA-Ala-GGC |
| 3017 | tRNA-Ala-GGC |
| 3018 | tRNA-Glu-TTC |
| 3019 | tRNA-Ala-GGC |
| 3020 | Cystine ABC transporter, periplasmic cystine-binding protein FliY |
| 3021 | Cystine ABC transporter, permease protein |
| 3022 | putative amino-acid ABC transporter, ATP-binding protein |
| 3023 | Probable two-component response regulator |
| 3024 | probable sensor/response regulatory hybrid protein (EC: 2.7.3.—) |
| 3025 | putative sensor/response regulator hybrid |
| 3026 | tRNA-Ala-GGC |
| 3027 | Phytoene synthase (EC 2.5.1.32) |
| 3028 | Phytoene synthase (EC 2.5.1.32) |
| 3029 | Phytoene desaturase, pro-zeta-carotene producing (EC 1.—.—.—) |
| 3030 | Short chain dehydrogenase |
| 3031 | hypothetical protein |
| 3032 | DNA repair protein RadA |
| 3033 | RNA polymerase sigma-70 factor |
| 3034 | hypothetical protein |
| 3035 | hypothetical protein |
| 3036 | Ribosomal RNA large subunit methyltransferase F (EC 2.1.1.51) |
| 3037 | hypothetical protein |
| 3038 | hypothetical protein |
| 3039 | amino acid ABC transporter, periplasmic-binding protein |
| 3040 | RTX toxins and related Ca2+-binding proteins |
| 3041 | hypothetical protein |
| 3042 | Ubiquinone biosynthesis monooxygenase UbiB |
| 3043 | Cell wall-associated hydrolases (invasion-associated proteins) |
| 3044 | FIG00507830: hypothetical protein |
| 3045 | Lipoprotein releasing system transmembrane protein LolC |
| 3046 | Lipoprotein releasing system ATP-binding protein LolD |
| 3047 | Potassium efflux system KefA protein/Small-conductance mechanosensitive channel |
| 3048 | probable transcriptional regulatory, LuxR family |
| 3049 | Dihydroneopterin triphosphate pyrophosphohydolase type 2 |
| 3050 | hypothetical protein |
| 3051 | Predicted phosphohydrolases |
| 3052 | Probable glucarate transporter |
| 3053 | Gluconokinase (EC 2.7.1.12) |
| 3054 | Gluconate utilization system Gnt-I transcriptional repressor |
| 3055 | probable negative transcriptional regulator |
| 3056 | hypothetical protein |
| 3057 | diguanylate cyclase/phosphodiesterase (GGDEF & EAL domains) with PAS/PAC sensor(s) |
| 3058 | hypothetical protein |
| 3059 | GCN5-related N-acetyltransferase |
| 3060 | probable acetyltransferase (EC: 2.3.1.—) |
| 3061 | hypothetical protein |
| 3062 | hypothetical protein |
| 3063 | hypothetical protein |
| 3064 | hypothetical protein |
| 3065 | 3'-5' exonuclease domain similar to epsilon subunit of DNA polymerase III, PA3232-type |
| 3066 | Predicted signal-transduction protein containing cAMP-binding and CBS domains |
| 3067 | Glutamine amidotransferase, class-II |
| 3068 | LysR-family transcriptional regulator clustered with PA0057 |

TABLE 19-continued

| SEQ ID NO. | function |
|---|---|
| 3069 | Metallo-beta-lactamase superfamily protein PA0057 |
| 3070 | Thioredoxin-like protein clustered with PA0057 |
| 3071 | Chitinase (EC 3.2.1.14) |
| 3072 | probable peptidyl-prolyl cis-trans isomerase |
| 3073 | probable signal peptide protein |
| 3074 | probable signal peptide protein |
| 3075 | Cell division protein BolA |
| 3076 | YciL protein |
| 3077 | Intracellular septation protein IspA |
| 3078 | hypothetical protein |
| 3079 | FIG000605: protein co-occurring with transport systems (COG1739) |
| 3080 | Exopolyphosphatase-related protein |
| 3081 | probable hydrolase |
| 3082 | putative partition-related protein |
| 3083 | GMP reductase (EC 1.7.1.7) |
| 3084 | Acyl dehydratase |
| 3085 | probable hydrolase |
| 3086 | N-acetyltransferase |
| 3087 | [Protein-PII] uridylyltransferase (EC 2.7.7.59) |
| 3088 | FIG000906: Predicted Permease |
| 3089 | FIG000988: Predicted permease |
| 3090 | Cytosol aminopeptidase PepA (EC 3.4.11.1) |
| 3091 | DNA polymerase III chi subunit (EC 2.7.7.7) |
| 3092 | hypothetical protein |
| 3093 | Cob(I)alamin adenosyltransferase PduO (EC 2.5.1.17) |
| 3094 | Sodium-dependent phosphate transporter |
| 3095 | Mobile element protein |
| 3096 | Cystine ABC transporter, periplasmic cystine-binding protein FliY |
| 3097 | tRNA-Ala-GGC |
| 3098 | tRNA-Glu-TTC |
| 3099 | tRNA-Ala-GGC |
| 3100 | tRNA-Ala-GGC |
| 3101 | Flagellar protein FlgJ [peptidoglycan hydrolase] (EC 3.2.1.—) |
| 3102 | hypothetical protein |
| 3103 | hypothetical protein |
| 3104 | transcriptional regulator, Crp/Fnr family |
| 3105 | Flagellar motor rotation protein MotB |
| 3106 | Flagellar motor rotation protein MotA |
| 3107 | RNA polymerase sigma factor for flagellar operon |
| 3108 | hypothetical protein |
| 3109 | Flagellar hook-length control protein FliK |
| 3110 | hypothetical protein |
| 3111 | Flagellar biosynthesis protein FliS |
| 3112 | Flagellar hook-associated protein FliD |
| 3113 | hypothetical protein |
| 3114 | Flagellum-specific ATP synthase FliI |
| 3115 | Flagellar assembly protein FliH |
| 3116 | Flagellar motor switch protein FliG |
| 3117 | Flagellar M-ring protein FliF |
| 3118 | Flagellar hook-basal body complex protein FliE |
| 3119 | FIG00456079: hypothetical protein |
| 3120 | Flagellar motor switch protein FliN |
| 3121 | Flagellar biosynthesis protein FliP |
| 3122 | Flagellar biosynthesis protein FliQ |
| 3123 | Flagellar biosynthesis protein FliR |
| 3124 | Flagellar biosynthesis protein FlhB |
| 3125 | Flagellar biosynthesis protein FlhA |
| 3126 | hypothetical protein |
| 3127 | hypothetical protein |
| 3128 | FIG00454871: hypothetical protein |
| 3129 | probable sensor/response regulator hybrid |
| 3130 | hypothetical protein |
| 3131 | Flagellin protein FlaA |
| 3132 | probable serine carboxypeptidase |
| 3133 | Ribose ABC transport system, periplasmic ribose-binding protein RbsB (TC 3.A.1.2.1) |
| 3134 | Ribose ABC transport system, periplasmic ribose-binding protein RbsB (TC 3.A.1.2.1) |
| 3135 | Ribose ABC transport system, permease protein RbsC (TC 3.A.1.2.1) |
| 3136 | Ribose ABC transport system, ATP-binding protein RbsA (TC 3.A.1.2.1) |
| 3137 | Ribose ABC transport system, high affinity permease RbsD (TC 3.A.1.2.1) |
| 3138 | Ribokinase (EC 2.7.1.15) |
| 3139 | Mg(2+) transport ATPase protein C |
| 3140 | ATPase, AFG1 family |
| 3141 | hypothetical protein |
| 3142 | Cysteine synthase B (EC 2.5.1.47) |
| 3143 | L-lactate permease |
| 3144 | Predicted D-lactate dehydrogenase, Fe—S protein, FAD/FMN-containing |

TABLE 19-continued

| SEQ ID NO. | function |
|---|---|
| 3145 | Predicted L-lactate dehydrogenase, Iron-sulfur cluster-binding subunit YkgF |
| 3146 | Predicted L-lactate dehydrogenase, hypothetical protein subunit YkgG |
| 3147 | Predicted L-lactate dehydrogenase, Fe—S oxidoreductase subunit YkgE |
| 3148 | Transcriptional regulator, ArsR family |
| 3149 | Arsenate reductase (EC 1.20.4.1) |
| 3150 | Arsenical-resistance protein ACR3 |
| 3151 | Lactate-responsive regulator LldR in Enterobacteria, GntR family |
| 3152 | ADP-L-glycero-D-manno-heptose-6-epimerase (EC 5.1.3.20) |
| 3153 | FIG027190: Putative transmembrane protein |
| 3154 | ADP-heptose synthase (EC 2.7.—.—)/D-glycero-beta-D-manno-heptose 7-phosphate kinase |
| 3155 | UDP-glucose dehydrogenase (EC 1.1.1.22) |
| 3156 | Orotidine 5'-phosphate decarboxylase (EC 4.1.1.23) |
| 3157 | Heat shock (predicted periplasmic) protein YciM, precursor |
| 3158 | FIG00507951: hypothetical protein |
| 3159 | Integration host factor beta subunit |
| 3160 | SSU ribosomal protein S1p |
| 3161 | Cytidylate kinase (EC 2.7.4.14) |
| 3162 | hypothetical protein |
| 3163 | 5-Enolpyruvylshikimate-3-phosphate synthase (EC 2.5.1.19) |
| 3164 | hypothetical protein |
| 3165 | cytochrome b561 |
| 3166 | Transcriptional regulator IacI family |
| 3167 | hypothetical protein |
| 3168 | Phosphoenolpyruvate-protein phosphotransferase of PTS system (EC 2.7.3.9) |
| 3169 | 1-phosphofructokinase (EC 2.7.1.56) |
| 3170 | PTS system, fructose-specific IIB component (EC 2.7.1.69)/PTS system, fructose-specific IIC component (EC 2.7.1.69) |
| 3171 | hypothetical protein |
| 3172 | Putative diheme cytochrome c-553 |
| 3173 | hypothetical protein |
| 3174 | Inner membrane protein |
| 3175 | hypothetical protein |
| 3176 | transcriptional regulator, LysR family |
| 3177 | Enoyl-CoA hydratase [valine degradation] (EC 4.2.1.17) |
| 3178 | Heavy-metal-associated domain (N-terminus) and membrane-bounded cytochrome biogenesis cycZ-like domain, possible membrane copper tolerance protein |
| 3179 | Zinc ABC transporter, periplasmic-binding protein ZnuA |
| 3180 | Zinc ABC transporter, inner membrane permease protein ZnuB |
| 3181 | Zinc ABC transporter, ATP-binding protein ZnuC |
| 3182 | hypothetical protein |
| 3183 | Putative metal chaperone, involved in Zn homeostasis, GTPase of COG0523 family |
| 3184 | Zinc uptake regulation protein ZUR |
| 3185 | Cytochrome c' |
| 3186 | Cytochrome c' |
| 3187 | Ni,Fe-hydrogenase I cytochrome b subunit |
| 3188 | Tyrosyl-tRNA synthetase (EC 6.1.1.1) |
| 3189 | NAD(P)H-flavin oxidoreductase |
| 3190 | hypothetical protein |
| 3191 | Heavy-chain fibroin (Fragment) |
| 3192 | hypothetical protein |
| 3193 | hypothetical protein |
| 3194 | hypothetical protein |
| 3195 | DNA repair protein RadC |
| 3196 | Phosphopantothenoylcysteine decarboxylase (EC 4.1.1.36)/ Phosphopantothenoylcysteine synthetase (EC 6.3.2.5) |
| 3197 | Deoxyuridine 5'-triphosphate nucleotidohydrolase (EC 3.6.1.23) |
| 3198 | probable GGDEF family regulatory protein |
| 3199 | 5'-nucleotidase (EC 3.1.3.5) |
| 3200 | NAD-specific glutamate dehydrogenase (EC 1.4.1.2), large form |
| 3201 | Lysine-arginine-ornithine-binding periplasmic protein precursor (TC 3.A.1.3.1) |
| 3202 | Histidine ABC transporter, permease protein HisQ (TC 3.A.1.3.1) |
| 3203 | Histidine ABC transporter, permease protein HisM (TC 3.A.1.3.1) |
| 3204 | hypothetical protein |
| 3205 | Arginine pathway regulatory protein ArgR, repressor of arg regulon |
| 3206 | Small Subunit Ribosomal RNA; ssuRNA; SSU rRNA |
| 3207 | 5S RNA |
| 3208 | Similar to phosphoglycolate phosphatase, clustered with ubiquinone biosynthesis SAM-dependent O-methyltransferase |
| 3209 | Threonine dehydratase biosynthetic (EC 4.3.1.19) |
| 3210 | D-alanyl-D-alanine carboxypeptidase (EC 3.4.16.4) |
| 3211 | Proposed lipoate regulatory protein YbeD |
| 3212 | Octanoate-[acyl-carrier-protein]-protein-N-octanoyltransferase |
| 3213 | Lipoate synthase |
| 3214 | hypothetical protein |
| 3215 | hypothetical protein |

TABLE 19-continued

| SEQ ID NO. | function |
|---|---|
| 3216 | TniB NTP-binding protein |
| 3217 | Mobile element protein |
| 3218 | FIGfam050825 |
| 3219 | hypothetical protein |
| 3220 | hypothetical protein |
| 3221 | hypothetical protein |
| 3222 | hypothetical protein |
| 3223 | Mg(2+) transport ATPase, P-type (EC 3.6.3.2) |
| 3224 | Benzoylformate decarboxylase (EC 4.1.1.7) |
| 3225 | Tryptophan 2-monooxygenase (EC 1.13.12.3) |
| 3226 | porin signal peptide protein |
| 3227 | sensor histidine kinase |
| 3228 | probable two-component response regulator |
| 3229 | Integral membrane protein TerC |
| 3230 | heat shock protein |
| 3231 | Transcriptional regulator, LysR family |
| 3232 | Type IV fimbrial biogenesis protein FimT |
| 3233 | Type IV fimbrial biogenesis protein PilV |
| 3234 | Type IV fimbrial biogenesis protein PilW |
| 3235 | Type IV fimbrial biogenesis protein PilX |
| 3236 | Type IV fimbrial biogenesis protein PilY1 |
| 3237 | Type IV pilus biogenesis protein PilE |
| 3238 | probable acyl-CoA-binding protein |
| 3239 | hypothetical protein |
| 3240 | Thiol:disulfide interchange protein DsbC |
| 3241 | 2-octaprenyl-3-methyl-6-methoxy-1,4-benzoquinol hydroxylase (EC 1.14.13.—) |
| 3242 | 2-octaprenyl-6-methoxyphenol hydroxylase (EC 1.14.13.—) |
| 3243 | Xaa-Pro aminopeptidase (EC 3.4.11.9) |
| 3244 | hypothetical protein |
| 3245 | FIG000859: hypothetical protein YebC |
| 3246 | Flagellar biosynthesis protein FliR |
| 3247 | Flagellar biosynthesis protein FliQ |
| 3248 | Acetyltransferase (EC 2.3.1.—) |
| 3249 | Flagellar biosynthesis protein FliP |
| 3250 | Flagellar biosynthesis protein FliQ |
| 3251 | Flagellar motor switch protein FliN |
| 3252 | Flagellar motor switch protein FliM |
| 3253 | Flagellar biosynthesis protein FliL |
| 3254 | Flagellar hook-length control protein FliK |
| 3255 | Flagellar protein FliJ |
| 3256 | Flagellum-specific ATP synthase FliI |
| 3257 | Flagellar assembly protein FliH |
| 3258 | Flagellar motor switch protein FliG |
| 3259 | Flagellar M-ring protein FliF |
| 3260 | Flagellar hook-basal body complex protein FliE |
| 3261 | Flagellar regulatory protein FleQ |
| 3262 | Chemotaxis response regulator protein-glutamate methylesterase CheB (EC 3.1.1.61) |
| 3263 | Low molecular weight protein tyrosine phosphatase (EC 3.1.3.48) |
| 3264 | hypothetical protein |
| 3265 | conserved hypothetical protein, possibly involved in regulation of phenolics degradation |
| 3266 | phosphoesterase |
| 3267 | lipase family protein |
| 3268 | LysR family transcriptional regulator YfeR |
| 3269 | Sodium/bile acid symporter family |
| 3270 | Excinuclease ABC subunit B |
| 3271 | hypothetical protein |
| 3272 | Murein-DD-endopeptidase (EC 3.4.99.—) |
| 3273 | GCN5-related N-acetyltransferase (EC 2.3.1.57) |
| 3274 | Phospholipid-binding protein |
| 3275 | Transcriptional regulator, AraC family |
| 3276 | hypothetical protein |
| 3277 | Transcriptional regulator, MarR family |
| 3278 | Ferric iron ABC transporter, ATP-binding protein |
| 3279 | Thiamin ABC transporter, transmembrane component |
| 3280 | hypothetical protein |
| 3281 | Iron(III)-binding periplasmic protein SfuA/Thiamin ABC transporter, substrate-binding component |
| 3282 | hypothetical protein |
| 3283 | PROBABLE SIGNAL PEPTIDE PROTEIN |
| 3284 | hypothetical protein |
| 3285 | probable amino acid ABC transporter, periplasmic-binding protein |
| 3286 | hypothetical protein |
| 3287 | Predicted transcription regulator, contains HTH domain (MarR family) |
| 3288 | Allophanate hydrolase 2 subunit 1 (EC 3.5.1.54) |
| 3289 | Allophanate hydrolase 2 subunit 2 (EC 3.5.1.54) |

TABLE 19-continued

| SEQ ID NO. | function |
| --- | --- |
| 3290 | Lactam utilization protein LamB |
| 3291 | FIG015373: Membrane protein |
| 3292 | FIG001614: Membrane protein |
| 3293 | Pyrrolidone-carboxylate peptidase (EC 3.4.19.3) |
| 3294 | Mannose-1-phosphate guanylyltransferase (GDP) (EC 2.7.7.22) |
| 3295 | hypothetical protein |
| 3296 | Phenylalanine-4-hydroxylase (EC 1.14.16.1) |
| 3297 | Transcriptional regulator, AsnC family |
| 3298 | Cysteine dioxygenase (EC 1.13.11.20) |
| 3299 | Long-chain fatty acid transport protein |
| 3300 | Peptidyl-prolyl cis-trans isomerase ppiB (EC 5.2.1.8) |
| 3301 | Peptidyl-prolyl cis-trans isomerase PpiB (EC 5.2.1.8) |
| 3302 | UDP-2,3-diacylglucosamine hydrolase (EC 3.6.1.—) |
| 3303 | hypothetical protein |
| 3304 | TonB-dependent receptor |
| 3305 | hypothetical protein |
| 3306 | tellurium resistance protein TerD |
| 3307 | hypothetical protein |
| 3308 | hypothetical protein |
| 3309 | tRNA(Ile)-lysidine synthetase |
| 3310 | Acetyl-coenzyme A carboxyl transferase alpha chain (EC 6.4.1.2) |
| 3311 | tRNA-Val-TAC |
| 3312 | tRNA-Asp-GTC |
| 3313 | tRNA-Val-TAC |
| 3314 | tRNA-Asp-GTC |
| 3315 | putative peptidoglycan binding protein |
| 3316 | probable Two component sensor |
| 3317 | Periplasmic thiol:disulfide oxidoreductase DsbB, required for DsbA reoxidation |
| 3318 | Patatin |
| 3319 | DNA-3-methyladenine glycosylase II (EC 3.2.2.21) |
| 3320 | Alkylated DNA repair protein AlkB |
| 3321 | TldE/PmbA protein, part of proposed TldE/TldD proteolytic complex (PMID 12029038) |
| 3322 | FIG138315: Putative alpha helix protein |
| 3323 | Molybdopterin biosynthesis Mog protein, molybdochelatase |
| 3324 | Hydrolase, alpha/beta fold family |
| 3325 | hypothetical protein |
| 3326 | hypothetical protein |
| 3327 | hypothetical protein |
| 3328 | Dienelactone hydrolase family |
| 3329 | hypothetical protein |
| 3330 | Cold shock protein CspA |
| 3331 | hypothetical protein |
| 3332 | acyltransferase family protein |
| 3333 | Osmotically inducible lipoprotein B precursor |
| 3334 | dNTP triphosphohydrolase, broad substrate specificity, subgroup 3 |
| 3335 | phosphoglycerate mutase 2 (EC: 5.4.2.1) |
| 3336 | Peptide methionine sulfoxide reductase MsrB (EC 1.8.4.12) |
| 3337 | hypothetical protein |
| 3338 | hypothetical protein |
| 3339 | hypothetical protein |
| 3340 | hypothetical protein |
| 3341 | hypothetical protein |
| 3342 | hypothetical protein |
| 3343 | Superfamily II DNA and RNA helicase |
| 3344 | C-5 cytosine-specific DNA methylase |
| 3345 | Nudix-related transcriptional regulator NrtR |
| 3346 | ribose-phosphate pyrophosphokinase (EC: 2.7.6.1) |
| 3347 | Nicotinamide phosphoribosyltransferase (EC 2.4.2.12) |
| 3348 | DNA helicase |
| 3349 | Signal transduction histidine kinase |
| 3350 | Two-component system response regulator QseB |
| 3351 | hypothetical protein |
| 3352 | Phosphoesterase, PA-phosphatase related |
| 3353 | Cytochrome B561 |
| 3354 | hypothetical protein |
| 3355 | hypothetical protein |
| 3356 | Leucine-responsive regulatory protein, regulator for leucine (or lrp) regulon and high-affinity branched-chain amino acid transport system |
| 3357 | L-lysine permease |
| 3358 | Transcriptional regulator, LysR family |
| 3359 | L-lysine permease |
| 3360 | hypothetical protein |
| 3361 | Hypothetical NagD-like phosphatase, Actinobacterial subfamily |
| 3362 | hypothetical protein |
| 3363 | hypothetical protein |
| 3364 | Copper-sensing two-component system response regulator CpxR |

TABLE 19-continued

| SEQ ID NO. | function |
|---|---|
| 3365 | Hypothetical Protein |
| 3366 | hypothetical protein |
| 3367 | Transaldolase (EC 2.2.1.2) |
| 3368 | Homolog of fucose/glucose/galactose permeases |
| 3369 | hypothetical protein |
| 3370 | CoA transferase, CAIB/BAIF family |
| 3371 | Citrate synthase (si) (EC 2.3.3.1) |
| 3372 | hypothetical protein |
| 3373 | hypothetical protein |
| 3374 | Microbial collagenase, secreted (EC 3.4.24.3) |
| 3375 | Transcriptional regulator, AraC family |
| 3376 | probable sensory transduction histidine kinase |
| 3377 | diguanylate cyclase/phosphodiesterase (GGDEF & EAL domains) with PAS/PAC sensor(s) |
| 3378 | cold shock transcription regulator protein |
| 3379 | Histone acetyltransferase HPA2 and related acetyltransferases |
| 3380 | hypothetical protein |
| 3381 | hypothetical protein |
| 3382 | hypothetical protein |
| 3383 | hypothetical protein |
| 3384 | hypothetical protein |
| 3385 | hypothetical protein |
| 3386 | hypothetical protein |
| 3387 | hypothetical protein |
| 3388 | vioD - hydroxylase |
| 3389 | Kynurenine 3-monooxygenase (EC 1.14.13.9) |
| 3390 | Violacein biosynthesis protein vioB |
| 3391 | vioA - tryptophan 2-monooxygenase |
| 3392 | hypothetical protein |
| 3393 | probable sphingomyelinase/beta-hemolysin |
| 3394 | hypothetical protein |
| 3395 | hypothetical protein |
| 3396 | Protein ycel precursor |
| 3397 | Probable signal peptide protein |
| 3398 | probable cytochrome b561 |
| 3399 | conserved hypothetical protein |
| 3400 | putative methyltransferase |
| 3401 | Putative membrane protein, clustering with ActP |
| 3402 | Acetate permease ActP (cation/acetate symporter) |
| 3403 | Acetyl-coenzyme A synthetase (EC 6.2.1.1) |
| 3404 | hypothetical protein |
| 3405 | hypothetical protein |
| 3406 | hypothetical protein |
| 3407 | 4-carboxymuconolactone decarboxylase (EC 4.1.1.44) |
| 3408 | transcriptional regulator, LysR family |
| 3409 | Iron-sulfur cluster-binding protein |
| 3410 | Endonuclease III (EC 4.2.99.18) |
| 3411 | hypothetical protein |
| 3412 | conserved hypothetical protein |
| 3413 | hypothetical protein |
| 3414 | Amino acid transporters |
| 3415 | hypothetical protein |
| 3416 | Maltoporin (maltose/maltodextrin high-affinity receptor, phage lambda receptor protein) |
| 3417 | Trehalose-6-phosphate hydrolase (EC 3.2.1.93) |
| 3418 | PTS system, trehalose-specific IIB component (EC 2.7.1.69)/PTS system, trehalose-specific IIC component (EC 2.7.1.69) |
| 3419 | hypothetical protein |
| 3420 | Trehalose operon transcriptional repressor |
| 3421 | Transcriptional regulator, LysR family |
| 3422 | Malate synthase (EC 2.3.3.9) |
| 3423 | Protein of unknown function DUF541 |
| 3424 | Glutathione S-transferase family protein |
| 3425 | Probable transmembrane protein |
| 3426 | hypothetical protein |
| 3427 | hypothetical protein |
| 3428 | glycosyl transferase, group 1 |
| 3429 | hypothetical protein |
| 3430 | hypothetical protein |
| 3431 | PUTATIVE TRANSMEMBRANE PROTEIN |
| 3432 | HflK protein |
| 3433 | HflC protein |
| 3434 | probable membrane transport protein |
| 3435 | Integral membrane protein |
| 3436 | Chitodextrinase precursor (EC 3.2.1.14) |
| 3437 | hypothetical protein |
| 3438 | SgrR, sugar-phosphate stress, transcriptional activator of SgrS small RNA |

TABLE 19-continued

| SEQ ID NO. | function |
|---|---|
| 3439 | hypothetical protein |
| 3440 | hypothetical protein |
| 3441 | tRNA-Gly-CCC |
| 3442 | hypothetical protein |
| 3443 | Glutathione-regulated potassium-efflux system protein KefB |
| 3444 | Arabinose 5-phosphate isomerase (EC 5.3.1.13) |
| 3445 | 3-deoxy-D-manno-octulosonate 8-phosphate phosphatase (EC 3.1.3.45) |
| 3446 | Uncharacterized protein YrbK clustered with lipopolysaccharide transporters |
| 3447 | LptA, protein essential for LPS transport across the periplasm |
| 3448 | Lipopolysaccharide ABC transporter, ATP-binding protein LptB |
| 3449 | RNA polymerase sigma-54 factor RpoN |
| 3450 | Ribosome hibernation protein YhbH |
| 3451 | PTS system nitrogen-specific IIA component, PtsN |
| 3452 | HPr kinase/phosphorylase (EC 2.7.1.—) (EC 2.7.4.—) |
| 3453 | FIG000506: Predicted P-loop-containing kinase |
| 3454 | 3-polyprenyl-4-hydroxybenzoate carboxy-lyase UbiX (EC 4.1.1.—) |
| 3455 | NAD(P)HX epimerase/NAD(P)HX dehydratase |
| 3456 | Permease of the drug/metabolite transporter (DMT) superfamily |
| 3457 | two-component sensor histidine kinase protein |
| 3458 | Response regulator |
| 3459 | COG1272: Predicted membrane protein hemolysin III homolog |
| 3460 | Adenylate kinase (EC 2.7.4.3) |
| 3461 | 3-deoxy-manno-octulosonate cytidylyltransferase (EC 2.7.7.38) |
| 3462 | FIG002473: Protein YcaR in KDO2-Lipid A biosynthesis cluster |
| 3463 | Tetraacyldisaccharide 4'-kinase (EC 2.7.1.130) |
| 3464 | Biopolymer transport protein ExbD/ToIR |
| 3465 | MotA/ToIQ/ExbB proton channel family protein |
| 3466 | hypothetical protein |
| 3467 | Transcriptional regulator, ArsR family |
| 3468 | 2,3-bisphosphoglycerate-independent phosphoglycerate mutase (EC 5.4.2.1) |
| 3469 | Periplasmic septal ring factor with murein hydrolase activity EnvC/YibP |
| 3470 | N-acetylglutamate synthase (EC 2.3.1.1) |
| 3471 | FIG001341: Probable Fe(2+)-trafficking protein YggX |
| 3472 | Polyphosphate kinase (EC 2.7.4.1) |
| 3473 | probable membrane protein NMA1128 |
| 3474 | ATPases with chaperone activity, ATP-binding subunit |
| 3475 | Glutathione-regulated potassium-efflux system ATP-binding protein |
| 3476 | hypothetical protein |
| 3477 | probable lipoprotein |
| 3478 | putative lipoprotein |
| 3479 | Integral membrane protein |
| 3480 | hypothetical protein |
| 3481 | hypothetical protein |
| 3482 | Fumarate reductase subunit D |
| 3483 | Fumarate reductase subunit C |
| 3484 | Succinate dehydrogenase iron-sulfur protein (EC 1.3.99.1) |
| 3485 | Succinate dehydrogenase flavoprotein subunit (EC 1.3.99.1) |
| 3486 | Uncharacterized hydroxylase PA0655 |
| 3487 | Inorganic pyrophosphatase (EC 3.6.1.1) |
| 3488 | hypothetical protein |
| 3489 | granule-associated protein |
| 3490 | Septum site-determining protein MinC |
| 3491 | Septum site-determining protein MinD |
| 3492 | Cell division topological specificity factor MinE |
| 3493 | Hydrogen peroxide-inducible genes activator |
| 3494 | hypothetical protein |
| 3495 | hypothetical protein |
| 3496 | response regulator |
| 3497 | DNA-binding response regulator, LuxR family |
| 3498 | hypothetical protein |
| 3499 | Signal transduction histidine kinase CheA (EC 2.7.3.—) |
| 3500 | hypothetical protein |
| 3501 | Chemotaxis regulator - transmits chemoreceptor signals to flagelllar motor components CheY |
| 3502 | Positive regulator of CheA protein activity (CheW) |
| 3503 | Methyl-accepting chemotaxis protein I (serine chemoreceptor protein) |
| 3504 | hypothetical protein |
| 3505 | Methyl-accepting chemotaxis protein |
| 3506 | Dipeptidyl carboxypeptidase Dcp (EC 3.4.15.5) |
| 3507 | hypothetical protein |
| 3508 | hypothetical protein |
| 3509 | Dipeptidyl carboxypeptidase Dcp (EC 3.4.15.5) |
| 3510 | hypothetical protein |
| 3511 | Transcriptional regulator, MarR family |
| 3512 | Transcription elongation factor GreB |
| 3513 | MutT/nudix family protein |

TABLE 19-continued

| SEQ ID NO. | function |
|---|---|
| 3514 | Ribosomal large subunit pseudouridine synthase B (EC 4.2.1.70) |
| 3515 | Segregation and condensation protein B |
| 3516 | Acetyltransferase (EC 2.3.1.—) |
| 3517 | tRNA delta(2)-isopentenylpyrophosphate transferase (EC 2.5.1.8) |
| 3518 | hypothetical protein |
| 3519 | hypothetical protein |
| 3520 | Translation initiation inhibitor |
| 3521 | Cystathionine gamma-lyase (EC 4.4.1.1) |
| 3522 | Cystathionine beta-synthase (EC 4.2.1.22) |
| 3523 | probable methyltransferase |
| 3524 | Fatty acid desaturase (EC 1.14.19.1); Delta-9 fatty acid desaturase (EC 1.14.19.1) |
| 3525 | hypothetical protein |
| 3526 | hypothetical protein |
| 3527 | Bacterioferritin |
| 3528 | Bacterioferritin-associated ferredoxin |
| 3529 | Nudix-like NDP and NTP phosphohydrolase YmfB |
| 3530 | hypothetical protein |
| 3531 | tRNA-specific 2-thiouridylase MnmA |
| 3532 | Permeases of the major facilitator superfamily |
| 3533 | LysR family transcriptional regulator YnfL |
| 3534 | 3-oxoacyl-[acyl-carrier protein] reductase (EC 1.1.1.100) |
| 3535 | Cyclohexadienyl dehydrogenase (EC 1.3.1.12) (EC 1.3.1.43) |
| 3536 | hypothetical protein |
| 3537 | Proton/glutamate symport protein @ Sodium/glutamate symport protein |
| 3538 | Aminodeoxychorismate lyase (EC 4.1.3.38) |
| 3539 | Para-aminobenzoate synthase, aminase component (EC 2.6.1.85) # PabAa |
| 3540 | 3-oxoacyl-[acyl-carrier-protein] synthase, KASII (EC 2.3.1.41) |
| 3541 | Acyl carrier protein |
| 3542 | 3-oxoacyl-[acyl-carrier protein] reductase (EC 1.1.1.100) |
| 3543 | Malonyl CoA-acyl carrier protein transacylase (EC 2.3.1.39) |
| 3544 | 3-oxoacyl-[acyl-carrier-protein] synthase, KASIII (EC 2.3.1.41) |
| 3545 | Phosphate:acyl-ACP acyltransferase PlsX |
| 3546 | LSU ribosomal protein L32p |
| 3547 | COG1399 protein, clustered with ribosomal protein L32p |
| 3548 | Tetrapyrrole methylase family protein |
| 3549 | Nicotinate phosphoribosyltransferase (EC 2.4.2.11) |
| 3550 | FIG173306: hypothetical protein |
| 3551 | porin signal peptide protein |
| 3552 | Transcriptional regulator, TetR family |
| 3553 | Dipeptide-binding ABC transporter, periplasmic substrate-binding component (TC 3.A.1.5.2) |
| 3554 | Sensory box/GGDEF family protein |
| 3555 | tellurite resistance protein |
| 3556 | Glycine dehydrogenase [decarboxylating] (glycine cleavage system P protein) (EC 1.4.4.2) |
| 3557 | Glycine cleavage system H protein |
| 3558 | Aminomethyltransferase (glycine cleavage system T protein) (EC 2.1.2.10) |
| 3559 | Lysine/cadaverine antiporter membrane protein CadB |
| 3560 | glutamyl-Q-tRNA synthetase |
| 3561 | 4Fe—4S ferredoxin, iron-sulfur binding |
| 3562 | Chemotaxis protein CheD |
| 3563 | Chemotaxis response regulator protein-glutamate methylesterase CheB (EC 3.1.1.61) |
| 3564 | Chemotaxis protein methyltransferase CheR (EC 2.1.1.80) |
| 3565 | Methyl-accepting chemotaxis protein I (serine chemoreceptor protein) |
| 3566 | Positive regulator of CheA protein activity (CheW) |
| 3567 | Signal transduction histidine kinase CheA (EC 2.7.3.—) |
| 3568 | Chemotaxis regulator - transmits chemoreceptor signals to flagelllar motor components CheY |
| 3569 | hypothetical protein |
| 3570 | anti-sigma-factor antagonist |
| 3571 | Anti-sigma F factor antagonist (spoIIAA-2); Anti-sigma B factor antagonist RsbV |
| 3572 | Flagellar sensor histidine kinase FleS |
| 3573 | Chemotaxis protein CheV (EC 2.7.3.—) |
| 3574 | Chemotaxis protein CheV (EC 2.7.3.—) |
| 3575 | Chemotaxis regulator - transmits chemoreceptor signals to flagelllar motor components CheY |
| 3576 | Chemotaxis response - phosphatase CheZ |
| 3577 | Signal transduction histidine kinase CheA (EC 2.7.3.—) |
| 3578 | Predicted signal transduction protein |
| 3579 | Ribosomal-protein-S18p-alanine acetyltransferase (EC 2.3.1.—) |
| 3580 | Uracil-DNA glycosylase, family 4 |
| 3581 | LSU ribosomal protein L33p @ LSU ribosomal protein L33p, zinc-independent |
| 3582 | LSU ribosomal protein L28p |
| 3583 | CTP synthase (EC 6.3.4.2) |
| 3584 | 2-Keto-3-deoxy-D-manno-octulosonate-8-phosphate synthase (EC 2.5.1.55) |
| 3585 | Enolase (EC 4.2.1.11) |

TABLE 19-continued

| SEQ ID NO. | function |
|---|---|
| 3586 | Cell division protein DivIC (FtsB), stabilizes FtsL against RasP cleavage |
| 3587 | hypothetical protein |
| 3588 | UPF0125 protein yfjF |
| 3589 | Putative oligoketide cyclase/dehydratase or lipid transport protein YfjG |
| 3590 | tmRNA-binding protein SmpB |
| 3591 | hypothetical protein |
| 3592 | bifunctional GMP synthase/glutamine amidotransferase protein (EC: 6.3.5.2) |
| 3593 | LigA |
| 3594 | hypothetical protein |
| 3595 | diguanylate cyclase/phosphodiesterase (GGDEF & EAL domains) with PAS/PAC sensor(s) |
| 3596 | hypothetical protein |
| 3597 | major facilitator family transporter |
| 3598 | hypothetical protein |
| 3599 | transmembrane protein |
| 3600 | FIG00507729: hypothetical protein |
| 3601 | hypothetical protein |
| 3602 | hypothetical protein |
| 3603 | hypothetical protein |
| 3604 | tRNA-specific adenosine-34 deaminase (EC 3.5.4.—) |
| 3605 | hypothetical protein |
| 3606 | hypothetical protein |
| 3607 | SAM-dependent methyltransferases |
| 3608 | hypothetical protein |
| 3609 | Fumarate hydratase class I, aerobic (EC 4.2.1.2) |
| 3610 | hypothetical protein |
| 3611 | Mg(2+) transport ATPase protein C |
| 3612 | Manganese transport protein MntH |
| 3613 | hypothetical protein |
| 3614 | Permease of the drug/metabolite transporter (DMT) superfamily |
| 3615 | Transcriptional regulator, AraC family |
| 3616 | Deoxyribodipyrimidine photolyase (EC 4.1.99.3) |
| 3617 | FIG032225: Transcriptional regulator, LysR family |
| 3618 | FIG073159: hypothetical protein |
| 3619 | FIG123062: hypothetical protein |
| 3620 | Protein of unknown function UPF0060 |
| 3621 | Nitrite-sensitive transcriptional repressor NsrR |
| 3622 | Flavohemoprotein (Hemoglobin-like protein) (Flavohemoglobin) (Nitric oxide dioxygenase) (EC 1.14.12.17) |
| 3623 | Chitin binding protein |
| 3624 | Glucoamylase (EC 3.2.1.3) |
| 3625 | hypothetical protein |
| 3626 | GCN5-related N-acetyltransferase |
| 3627 | Nitric-oxide reductase (EC 1.7.99.7), quinol-dependent |
| 3628 | FIG01086056: hypothetical protein |
| 3629 | Choline dehydrogenase (EC 1.1.99.1) |
| 3630 | hypothetical protein |
| 3631 | D-serine dehydratase transcriptional activator |
| 3632 | D-serine dehydratase (EC 4.3.1.18) |
| 3633 | Transcriptional regulator, TetR family |
| 3634 | oxygen-insensitive NADPH nitroreductase |
| 3635 | N-ethylmaleimide reductase (EC 1.—.—.—) |
| 3636 | Transcriptional regulator, TetR family |
| 3637 | amidase |
| 3638 | hypothetical protein |
| 3639 | Prolyl endopeptidase (EC 3.4.21.26) |
| 3640 | hypothetical protein |
| 3641 | probable two-component response regulator |
| 3642 | Serine phosphatase RsbU, regulator of sigma subunit |
| 3643 | Queuosine Biosynthesis QueC ATPase |
| 3644 | Queuosine biosynthesis QueD, PTPS-I |
| 3645 | Queuosine Biosynthesis QueE Radical SAM |
| 3646 | Putative signal peptide protein |
| 3647 | Putative signal peptide protein |
| 3648 | Uncharacterized protein conserved in bacteria, NMA0228-like |
| 3649 | Conserved domain protein |
| 3650 | INTEGRAL MEMBRANE PROTEIN (Rhomboid family) |
| 3651 | Phosphoserine phosphatase (EC 3.1.3.3) |
| 3652 | hypothetical protein |
| 3653 | Molybdenum cofactor biosynthesis protein MoaA |
| 3654 | hypothetical protein |
| 3655 | 17 kDa surface antigen |
| 3656 | Acetoacetate decarboxylase (EC 4.1.1.4) |
| 3657 | hypothetical protein |
| 3658 | Uncharacterized oxidoreductase ydgJ (EC 1.—.—.—) |
| 3659 | 5S RNA |
| 3660 | 3'-to-5' exoribonuclease RNase R |

TABLE 19-continued

| SEQ ID NO. | function |
|---|---|
| 3661 | tRNA-Leu-CAG |
| 3662 | tRNA-Leu-CAG |
| 3663 | tRNA-Leu-CAG |
| 3664 | tRNA-Leu-CAG |
| 3665 | probable multidrug efflux protein |
| 3666 | Acid phosphatase |
| 3667 | Cytochrome c peroxidase (EC 1.11.1.5) |
| 3668 | Lactoylglutathione lyase (EC 4.4.1.5) |
| 3669 | Adenylosuccinate synthetase (EC 6.3.4.4) |
| 3670 | ATP phosphoribosyltransferase regulatory subunit (EC 2.4.2.17) |
| 3671 | HflC protein |
| 3672 | HflK protein |
| 3673 | GTP-binding protein HflX |
| 3674 | RNA-binding protein Hfq |
| 3675 | GTP-binding protein EngA |
| 3676 | Outer membrane protein YfgL, lipoprotein component of the protein assembly complex (forms a complex with YaeT, YfiO, and NlpB) |
| 3677 | Mlr7403 protein |
| 3678 | Histidyl-tRNA synthetase (EC 6.1.1.21) |
| 3679 | 1-hydroxy-2-methyl-2-(E)-butenyl 4-diphosphate synthase (EC 1.17.7.1) |
| 3680 | FIG021952: putative membrane protein |
| 3681 | Type IV pilus biogenesis protein PilF |
| 3682 | Ribosomal RNA large subunit methyltransferase N (EC 2.1.1.—) |
| 3683 | Nucleoside diphosphate kinase (EC 2.7.4.6) |
| 3684 | alginate regulatory protein AlgP |
| 3685 | tRNA-Gln-TTG |
| 3686 | tRNA-Thr-CGT |
| 3687 | tRNA-Pro-CGG |
| 3688 | tRNA-Pro-CGG |
| 3689 | DNA recombination-dependent growth factor C |
| 3690 | Catalase (EC 1.11.1.6) |
| 3691 | hypothetical protein |
| 3692 | Putative cytoplasmic protein |
| 3693 | Dihydroorotate dehydrogenase (EC 1.3.3.1) |
| 3694 | hypothetical protein |
| 3695 | probable bacterioferritin |
| 3696 | Ferrous iron transport protein B |
| 3697 | hypothetical protein |
| 3698 | Deoxycytidine triphosphate deaminase (EC 3.5.4.13) |
| 3699 | Glutathione peroxidase (EC 1.11.1.9) |
| 3700 | hypothetical protein |
| 3701 | Deacetylases, including yeast histone deacetylase and acetoin utilization protein |
| 3702 | UPF0225 protein YchJ |
| 3703 | hypothetical protein |
| 3704 | Cysteine synthase (EC 2.5.1.47) |
| 3705 | Potassium voltage-gated channel subfamily KQT; possible potassium channel, VIC family |
| 3706 | COG2110, Macro domain, possibly ADP-ribose binding module |
| 3707 | Exodeoxyribonuclease VII large subunit (EC 3.1.11.6) |
| 3708 | hypothetical protein |
| 3709 | 4-hydroxy-3-methylbut-2-enyl diphosphate reductase (EC 1.17.1.2) |
| 3710 | Lipoprotein signal peptidase (EC 3.4.23.36) |
| 3711 | Isoleucyl-tRNA synthetase (EC 6.1.1.5) |
| 3712 | Riboflavin kinase (EC 2.7.1.26)/FMN adenylyltransferase (EC 2.7.7.2) |
| 3713 | Outer membrane protein A precursor |
| 3714 | Oxidoreductase probably involved in sulfite reduction |
| 3715 | Sulfite reductase [NADPH] hemoprotein beta-component (EC 1.8.1.2) |
| 3716 | Phosphoadenylyl-sulfate reductase [thioredoxin] (EC 1.8.4.8)/Adenylyl-sulfate reductase [thioredoxin] (EC 1.8.4.10) |
| 3717 | Cys regulon transcriptional activator CysB |
| 3718 | 3-oxoacyl-[acyl-carrier protein] reductase (EC 1.1.1.100) |
| 3719 | ABC transporter ATP-binding protein uup |
| 3720 | Dihydrodipicolinate synthase (EC 4.2.1.52) |
| 3721 | FIG002207: Probable transmembrane protein |
| 3722 | hypothetical protein |
| 3723 | FIG002776: hypothetical protein |
| 3724 | FKBP-type peptidyl-prolyl cis-trans isomerase SlyD (EC 5.2.1.8) |
| 3725 | FIG00507126: hypothetical protein |
| 3726 | Methylase of polypeptide chain release factors |
| 3727 | Mg/Co/Ni transporter MgtE/CBS domain |
| 3728 | hypothetical protein |
| 3729 | Monofunctional biosynthetic peptidoglycan transglycosylase (EC 2.4.2.—) |
| 3730 | Shikimate 5-dehydrogenase I alpha (EC 1.1.1.25) |
| 3731 | Rhodanese-related sulfurtransferase |
| 3732 | hypothetical protein |
| 3733 | Glutamine synthetase type I (EC 6.3.1.2) |
| 3734 | FIG00974692: hypothetical protein |

TABLE 19-continued

| SEQ ID NO. | function |
|---|---|
| 3735 | Nitrogen regulation protein NR(II) (EC 2.7.3.—) |
| 3736 | Nitrogen regulation protein NR(I) |
| 3737 | hypothetical protein |
| 3738 | Biphenyl-2,3-diol 1,2-dioxygenase (EC 1.13.11.39) |
| 3739 | Transcriptional activator MetR |
| 3740 | 5-methyltetrahydropteroyltriglutamate--homocysteine methyltransferase (EC 2.1.1.14) |
| 3741 | Phosphohistidine phosphatase SixA |
| 3742 | LrgA-associated membrane protein LrgB |
| 3743 | Antiholin-like protein LrgA |
| 3744 | 4-hydroxybenzoate polyprenyltransferase (EC 2.5.1.39) |
| 3745 | hypothetical protein |
| 3746 | hypothetical protein |
| 3747 | Mutator mutT protein (7,8-dihydro-8-oxoguanine-triphosphatase) (EC 3.6.1.—)/ Thiamin-phosphate pyrophosphorylase-like protein |
| 3748 | Phosphoserine phosphatase (EC 3.1.3.3) |
| 3749 | DnaA regulatory inactivator Hda (Homologous to DnaA) |
| 3750 | hypothetical protein |
| 3751 | Phosphoribosylformylglycinamidine cyclo-ligase (EC 6.3.3.1) |
| 3752 | Phosphoribosylglycinamide formyltransferase (EC 2.1.2.2) |
| 3753 | hypothetical protein |
| 3754 | Fmu (Sun)/eukaryotic nucleolar NOL1/Nop2p; tRNA and rRNA cytosine-C5-methylases |
| 3755 | Chloride channel protein |
| 3756 | Glutaredoxin-related protein |
| 3757 | Uracil phosphoribosyltransferase (EC 2.4.2.9) |
| 3758 | hypothetical protein |
| 3759 | Uracil permease |
| 3760 | hypothetical protein |
| 3761 | Transcriptional regulator, LysR family |
| 3762 | hypothetical protein |
| 3763 | Acetyltransferase (EC 2.3.1.—) |
| 3764 | Acetyltransferase (EC 2.3.1.—) |
| 3765 | putative acetyltransferase |
| 3766 | Transcriptional regulator, AraC family |
| 3767 | hypothetical protein |
| 3768 | Isochorismatase (EC 3.3.2.1) |
| 3769 | hypothetical protein |
| 3770 | hypothetical protein |
| 3771 | transcriptional regulator, MarR family |
| 3772 | LSU ribosomal protein L9p |
| 3773 | SSU ribosomal protein S18p @ SSU ribosomal protein S18p, zinc-independent |
| 3774 | Primosomal replication protein N |
| 3775 | SSU ribosomal protein S6p |
| 3776 | hypothetical protein |
| 3777 | hypothetical protein |
| 3778 | hypothetical protein |
| 3779 | Multicopper oxidase |
| 3780 | Inositol-1-monophosphatase (EC 3.1.3.25) |
| 3781 | tRNA:Cm32/Um32 methyltransferase |
| 3782 | hypothetical protein |
| 3783 | transcriptional regulator, Crp/Fnr family |
| 3784 | Coproporphyrinogen III oxidase, oxygen-independent (EC 1.3.99.22) |
| 3785 | hypothetical protein |
| 3786 | probable sodium/alanine symporter |
| 3787 | hypothetical protein |
| 3788 | Glycerophosphoryl diester phosphodiesterase (EC 3.1.4.46) |
| 3789 | Glycerol-3-phosphate ABC transporter, ATP-binding protein UgpC (TC 3.A.1.1.3) |
| 3790 | Glycerol-3-phosphate ABC transporter, permease protein UgpE (TC 3.A.1.1.3) |
| 3791 | Glycerol-3-phosphate ABC transporter, permease protein UgpA (TC 3.A.1.1.3) |
| 3792 | Glycerol-3-phosphate ABC transporter, periplasmic glycerol-3-phosphate-binding protein (TC 3.A.1.1.3) |
| 3793 | Cytochrome d ubiquinol oxidase subunit II (EC 1.10.3.—) |
| 3794 | Cytochrome d ubiquinol oxidase subunit I (EC 1.10.3.—) |
| 3795 | Transcriptional regulator, ArsR family |
| 3796 | D-glycerate 2-kinase (EC 2.7.1.—) |
| 3797 | DNA mismatch repair protein MutS |
| 3798 | hypothetical protein |
| 3799 | Ribosomal large subunit pseudouridine synthase E (EC 4.2.1.70) |
| 3800 | Isocitrate dehydrogenase [NADP] (EC 1.1.1.42); Monomeric isocitrate dehydrogenase [NADP] (EC 1.1.1.42) |
| 3801 | Cold shock protein CspD |
| 3802 | Tyrosine recombinase XerD |
| 3803 | Methylated-DNA--protein-cysteine methyltransferase (EC 2.1.1.63) |
| 3804 | LSU ribosomal protein L19p |
| 3805 | tRNA (Guanine37-N1)-methyltransferase (EC 2.1.1.31) |
| 3806 | 16S rRNA processing protein RimM |
| 3807 | SSU ribosomal protein S16p |

TABLE 19-continued

| SEQ ID NO. | function |
|---|---|
| 3808 | Acetyl-CoA synthetase (ADP-forming) alpha and beta chains, putative |
| 3809 | hypothetical protein |
| 3810 | Quinolinate synthetase (EC 2.5.1.72) |
| 3811 | 5-nucleotidase SurE (EC 3.1.3.5) @ Exopolyphosphatase (EC 3.6.1.11) |
| 3812 | Protein-L-isoaspartate O-methyltransferase (EC 2.1.1.77) |
| 3813 | Lipoprotein NlpD |
| 3814 | RNA polymerase sigma factor RpoS |
| 3815 | FIG002343: hypothetical protein |
| 3816 | FIG022979: MoxR-like ATPases |
| 3817 | Deacetylases, including yeast histone deacetylase and acetoin utilization protein |
| 3818 | Signal peptidase I (EC 3.4.21.89) |
| 3819 | Acyl-phosphate:glycerol-3-phosphate O-acyltransferase PlsY |
| 3820 | Dihydroneopterin aldolase (EC 4.1.2.25) |
| 3821 | hypothetical protein |
| 3822 | Hemoglobin-like protein HbO |
| 3823 | D-amino acid dehydrogenase small subunit (EC 1.4.99.1) |
| 3824 | Chemotaxis protein methyltransferase CheR (EC 2.1.1.80) |
| 3825 | probable iron binding protein from the HesB_IscA_SufA family |
| 3826 | N-acetyl-gamma-glutamyl-phosphate reductase (EC 1.2.1.38) |
| 3827 | SSU ribosomal protein S9p (S16e) |
| 3828 | LSU ribosomal protein L13p (L13Ae) |
| 3829 | Purine nucleoside phosphorylase (EC 2.4.2.1) |
| 3830 | Phosphopentomutase (EC 5.4.2.7) |
| 3831 | Thymidine phosphorylase (EC 2.4.2.4) |
| 3832 | Deoxyribose-phosphate aldolase (EC 4.1.2.4) |
| 3833 | hypothetical protein |
| 3834 | GTP pyrophosphokinase (EC 2.7.6.5), (p)ppGpp synthetase I |
| 3835 | A/G-specific adenine glycosylase (EC 3.2.2.—) |
| 3836 | 23S rRNA (guanine-N-2-)-methyltransferase rlmL EC 2.1.1.—) |
| 3837 | hypothetical protein |
| 3838 | hypothetical protein |
| 3839 | Multiple antibiotic resistance protein marC |
| 3840 | Aerobic C4-dicarboxylate transporter for fumarate, L-malate, D-malate, succunate, aspartate |
| 3841 | probable thiol peroxidase |
| 3842 | Phosphoenolpyruvate synthase (EC 2.7.9.2) |
| 3843 | FIG137360: hypothetical protein |
| 3844 | hypothetical protein |
| 3845 | Nucleotidyltransferase (EC 2.7.7.—) |
| 3846 | Translation initiation factor SUI1-related protein |
| 3847 | hypothetical protein |
| 3848 | Tryptophanyl-tRNA synthetase (EC 6.1.1.2) |
| 3849 | Chorismate mutase |
| 3850 | Conserved uncharacterized protein CreA |
| 3851 | Metal-dependent hydrolases of the beta-lactamase superfamily I; PhnP protein |
| 3852 | hypothetical protein |
| 3853 | Putative deoxyribonuclease YcfH |
| 3854 | Type IV pilus biogenesis protein PilZ |
| 3855 | DNA polymerase III delta prime subunit (EC 2.7.7.7) |
| 3856 | Thymidylate kinase (EC 2.7.4.9) |
| 3857 | FIG004453: protein YceG like |
| 3858 | hypothetical protein |
| 3859 | Molybdenum ABC transporter, periplasmic molybdenum-binding protein ModA (TC 3.A.1.8.1) |
| 3860 | Molybdenum transport system permease protein ModB (TC 3.A.1.8.1) |
| 3861 | hypothetical protein |
| 3862 | hypothetical protein |
| 3863 | Flagellar hook-associated protein FliD |
| 3864 | Transcriptional regulator, GntR family |
| 3865 | hypothetical protein |
| 3866 | hypothetical protein |
| 3867 | ABC transporter, permease protein, putative |
| 3868 | ABC transporter, ATP-binding protein |
| 3869 | Arylesterase precursor (EC 3.1.1.2) |
| 3870 | major facilitator superfamily MFS_1 |
| 3871 | Alkyl hydroperoxide reductase subunit C-like protein |
| 3872 | Aspartyl-tRNA synthetase (EC 6.1.1.12) @ Aspartyl-tRNA(Asn) synthetase (EC 6.1.1.23) |
| 3873 | Transporter |
| 3874 | Type I antifreeze protein |
| 3875 | Enoyl-[acyl-carrier-protein] reductase [NADH] (EC 1.3.1.9) |
| 3876 | phosphate acetyltransferase (EC: 2.3.1.19, EC: 2.3.1.8) |
| 3877 | Acetate kinase (EC 2.7.2.1) |
| 3878 | SSU ribosomal protein S20p |
| 3879 | Proposed peptidoglycan lipid II flippase MurJ |
| 3880 | NADPH dependent preQ0 reductase (EC 1.7.1.13) |
| 3881 | Ribosomal large subunit pseudouridine synthase A (EC 4.2.1.70) |

TABLE 19-continued

| SEQ ID NO. | function |
|---|---|
| 3882 | Ser-tRNA(Ala) deacylase; Gly-tRNA(Ala) deacylase |
| 3883 | Di/tripeptide permease DtpA |
| 3884 | hypothetical protein |
| 3885 | Transcriptional activator protein LysR |
| 3886 | Diaminopimelate decarboxylase (EC 4.1.1.20) |
| 3887 | hypothetical protein |
| 3888 | Membrane-bound lytic murein transglycosylase A precursor (EC 3.2.1.—) |
| 3889 | hypothetical protein |
| 3890 | hypothetical protein |
| 3891 | hypothetical protein |
| 3892 | tRNA-Met-CAT |
| 3893 | RNA polymerase sigma factor RpoD |
| 3894 | DNA primase (EC 2.7.7.—) |
| 3895 | Transamidase GatB domain protein |
| 3896 | SSU ribosomal protein S21p |
| 3897 | Thiazole biosynthesis protein ThiG |
| 3898 | Sulfur carrier protein ThiS |
| 3899 | GTP pyrophosphokinase (EC 2.7.6.5), (p)ppGpp synthetase II/Guanosine-3',5'-bis(diphosphate) 3'-pyrophosphohydrolase (EC 3.1.7.2) |
| 3900 | DNA-directed RNA polymerase omega subunit (EC 2.7.7.6) |
| 3901 | Guanylate kinase (EC 2.7.4.8) |
| 3902 | Xanthine/uracil/thiamine/ascorbate permease family protein |
| 3903 | hypothetical protein |
| 3904 | Adenine phosphoribosyltransferase (EC 2.4.2.7) |
| 3905 | hypothetical protein |
| 3906 | hypothetical protein |
| 3907 | hypothetical protein |
| 3908 | Transcriptional regulator, PadR family |
| 3909 | hypothetical protein |
| 3910 | probable RebB like protein |
| 3911 | Carbamate kinase (EC 2.7.2.2) |
| 3912 | Ornithine carbamoyltransferase (EC 2.1.3.3) |
| 3913 | Arginine deiminase (EC 3.5.3.6) |
| 3914 | Arginine/ornithine antiporter ArcD |
| 3915 | hypothetical protein |
| 3916 | CDP-6-deoxy-delta-3,4-glucoseen reductase-like |
| 3917 | Nucleoside-diphosphate-sugar epimerases |
| 3918 | tRNA (guanine46-N7-)-methyltransferase (EC 2.1.1.33) |
| 3919 | Glutathione peroxidase (EC 1.11.1.9) |
| 3920 | hypothetical protein |
| 3921 | D-3-phosphoglycerate dehydrogenase (EC 1.1.1.95) |
| 3922 | putative cytochrome c oxidase, subunit I |
| 3923 | FKBP-type peptidyl-prolyl cis-trans isomerase |
| 3924 | DedA protein |
| 3925 | Alanine racemase (EC 5.1.1.1) |
| 3926 | extracellular nuclease, putative |
| 3927 | Phosphoglucosamine mutase (EC 5.4.2.10) |
| 3928 | Dihydropteroate synthase (EC 2.5.1.15) |
| 3929 | Cell division protein FtsH (EC 3.4.24.—) |
| 3930 | Cell division protein FtsJ/Ribosomal RNA large subunit methyltransferase E (EC 2.1.1.—) ## LSU rRNA Um2552 |
| 3931 | FIG004454: RNA binding protein |
| 3932 | Probable transmembrane protein |
| 3933 | Transcription elongation factor GreA |
| 3934 | Carbamoyl-phosphate synthase large chain (EC 6.3.5.5) |
| 3935 | L-lysine permease |
| 3936 | Carbamoyl-phosphate synthase small chain (EC 6.3.5.5) |
| 3937 | General secretion pathway protein N |
| 3938 | General secretion pathway protein M |
| 3939 | General secretion pathway protein L |
| 3940 | General secretion pathway protein K |
| 3941 | General secretion pathway protein J |
| 3942 | General secretion pathway protein I |
| 3943 | General secretion pathway protein H |
| 3944 | General secretion pathway protein G |
| 3945 | hypothetical protein |
| 3946 | General secretion pathway protein F |
| 3947 | General secretion pathway protein E |
| 3948 | General secretion pathway protein D |
| 3949 | hypothetical protein |
| 3950 | hypothetical protein |
| 3951 | Acyl-CoA dehydrogenase (EC 1.3.99.3) |
| 3952 | Electron transfer flavoprotein, alpha subunit |
| 3953 | Electron transfer flavoprotein, beta subunit |
| 3954 | probable maoC-like dehydratase |
| 3955 | Epoxyqueuosine (oQ) reductase QueG |

TABLE 19-continued

| SEQ ID NO. | function |
|---|---|
| 3956 | ATPase YjeE, predicted to have essential role in cell wall biosynthesis |
| 3957 | N-acetylmuramoyl-L-alanine amidase (EC 3.5.1.28) |
| 3958 | FIG003276: zinc-binding protein |
| 3959 | FIG002842: hypothetical protein |
| 3960 | Dephospho-CoA kinase (EC 2.7.1.24) |
| 3961 | Leader peptidase (Prepilin peptidase) (EC 3.4.23.43)/N-methyltransferase (EC 2.1.1.—) |
| 3962 | Type IV fimbrial assembly protein PilC |
| 3963 | Type IV fimbrial assembly, ATPase PilB |
| 3964 | porin signal peptide protein |
| 3965 | Late competence protein ComEA, DNA receptor |
| 3966 | hypothetical protein |
| 3967 | Signal recognition particle, subunit Ffh SRP54 (TC 3.A.5.1.1) |
| 3968 | Adenylosuccinate lyase (EC 4.3.2.2) |
| 3969 | FIG00487358: hypothetical protein |
| 3970 | Cobalt-zinc-cadmium resistance protein CzcA; Cation efflux system protein CusA |
| 3971 | Probable Co/Zn/Cd efflux system membrane fusion protein |
| 3972 | Heavy metal RND efflux outer membrane protein, CzcC family |
| 3973 | Formate dehydrogenase O alpha subunit (EC 1.2.1.2) |
| 3974 | Formate dehydrogenase O beta subunit (EC 1.2.1.2) |
| 3975 | Formate dehydrogenase O gamma subunit (EC 1.2.1.2) |
| 3976 | formate dehydrogenase formation protein FdhE |
| 3977 | Transcriptional regulatory protein RstA |
| 3978 | Sensory histidine kinase in two-component regulatory system with RstA |
| 3979 | Ku domain protein |
| 3980 | Ribonuclease PH (EC 2.7.7.56) |
| 3981 | Protein phosphatase 2C-like |
| 3982 | Serine/threonine protein kinase (EC 2.7.11.1) |
| 3983 | Protein YicC |
| 3984 | hypothetical protein |
| 3985 | Fe—S OXIDOREDUCTASE (1.8.—.—) |
| 3986 | Histone-like DNA-binding protein |
| 3987 | 2-hydroxy-3-oxopropionate reductase (EC 1.1.1.60) |
| 3988 | Flagellar biosynthesis protein FlhB |
| 3989 | FIG00726091: hypothetical protein |
| 3990 | hypothetical protein |
| 3991 | hypothetical protein |
| 3992 | Flagellar biosynthesis protein FliS |
| 3993 | Flagellar hook-associated protein FliD |
| 3994 | Flagellin protein FlaG |
| 3995 | Flagellin protein FlaA |
| 3996 | Flagellin protein FlaA |
| 3997 | O-antigen biosynthesis protein |
| 3998 | hypothetical protein |
| 3999 | hypothetical protein |
| 4000 | Glycosyltransferase-like |
| 4001 | hypothetical protein |
| 4002 | hypothetical protein |
| 4003 | dTDP-glucose 4,6-dehydratase (EC 4.2.1.46) |
| 4004 | hypothetical protein |
| 4005 | probable Fe—S oxidoreductase |
| 4006 | hypothetical protein |
| 4007 | probable methyltransferase |
| 4008 | Acetolactate synthase large subunit (EC 2.2.1.6) |
| 4009 | N-acetylneuraminate synthase (EC 2.5.1.56) |
| 4010 | CDP-4-dehydro-6-deoxy-D-glucose 3-dehydratase (EC 4.2.1.—) |
| 4011 | Similar to CDP-glucose 4,6-dehydratase (EC 4.2.1.45) |
| 4012 | Glucose-1-phosphate cytidylyltransferase (EC 2.7.7.33) |
| 4013 | 5'-methylthioadenosine phosphorylase (EC 2.4.2.28) |
| 4014 | hypothetical protein |
| 4015 | TonB-dependent hemin, ferrichrome receptor |
| 4016 | Hemin transport protein HmuS |
| 4017 | Periplasmic hemin-binding protein |
| 4018 | Hemin ABC transporter, permease protein |
| 4019 | ABC-type hemin transport system, ATPase component |
| 4020 | Hypoxanthine-guanine phosphoribosyltransferase (EC 2.4.2.8) |
| 4021 | UTP--glucose-1-phosphate uridylyltransferase (EC 2.7.7.9) |
| 4022 | FOG: TPR repeat |
| 4023 | DNA ligase (EC 6.5.1.2) |
| 4024 | Cell division protein |
| 4025 | Transcriptional regulator, MarR family |
| 4026 | Ferric siderophore transport system, periplasmic binding protein TonB |
| 4027 | Nitrate/nitrite transporter |
| 4028 | Chromosome partition protein smc |
| 4029 | UPF0301 protein YqgE |
| 4030 | Putative Holliday junction resolvase (EC 3.1.—.—) |
| 4031 | hypothetical protein |

TABLE 19-continued

| SEQ ID NO. | function |
|---|---|
| 4032 | hypothetical protein |
| 4033 | 50S ribosomal subunit maturation GTPase RbgA (B. subtilis YlqF) |
| 4034 | hypothetical protein |
| 4035 | Probable transmembrane protein |
| 4036 | hypothetical protein |
| 4037 | Electron transfer flavoprotein-ubiquinone oxidoreductase (EC 1.5.5.1) |
| 4038 | L-carnitine dehydratase/bile acid-inducible protein F (EC 2.8.3.16) |
| 4039 | Glutaryl-CoA dehydrogenase (EC 1.3.99.7) |
| 4040 | Transcriptional regulator, IclR family |
| 4041 | CBS domain protein |
| 4042 | Acetylglutamate kinase (EC 2.7.2.8) |
| 4043 | Transcriptional regulator, TetR family |
| 4044 | Probable Co/Zn/Cd efflux system membrane fusion protein |
| 4045 | RND efflux transporter |
| 4046 | Type I secretion outer membrane protein, TolC precursor |
| 4047 | Gamma-aminobutyrate:alpha-ketoglutarate aminotransferase (EC 2.6.1.19) |
| 4048 | Succinate-semialdehyde dehydrogenase [NADP+] (EC 1.2.1.16) |
| 4049 | Inner membrane component of tripartite multidrug resistance system |
| 4050 | Membrane fusion component of tripartite multidrug resistance system |
| 4051 | Outer membrane component of tripartite multidrug resistance system |
| 4052 | Transcriptional regulator, MarR family |
| 4053 | hypothetical protein |
| 4054 | Phosphoserine phosphatase (EC 3.1.3.3) |
| 4055 | hypothetical protein |
| 4056 | hypothetical protein |
| 4057 | hypothetical protein |
| 4058 | Transcriptional regulator, MarR family |
| 4059 | 5S RNA |
| 4060 | 5S RNA |
| 4061 | Uncharacterized protein ImpF |
| 4062 | Probable transmembrane protein |
| 4063 | Uncharacterized protein ImpJ/VasE |
| 4064 | hypothetical protein |
| 4065 | Probable transmembrane protein |
| 4066 | PROBABLE TRANSMEMBRANE PROTEIN |
| 4067 | hypothetical protein |
| 4068 | Uncharacterized protein ImpB |
| 4069 | Uncharacterized protein ImpC |
| 4070 | Uncharacterized protein ImpD |
| 4071 | hypothetical protein |
| 4072 | VgrG protein |
| 4073 | hypothetical protein |
| 4074 | hypothetical protein |
| 4075 | FOG: Ankyrin repeat-like |
| 4076 | Heme O synthase, protoheme IX farnesyltransferase (EC 2.5.1.—) COX10-CtaB |
| 4077 | Cytochrome O ubiquinol oxidase subunit IV (EC 1.10.3.—) |
| 4078 | Cytochrome O ubiquinol oxidase subunit III (EC 1.10.3.—) |
| 4079 | Cytochrome O ubiquinol oxidase subunit I (EC 1.10.3.—) |
| 4080 | Cytochrome O ubiquinol oxidase subunit II (EC 1.10.3.—) |
| 4081 | tRNA-Met-CAT |
| 4082 | tRNA-Met-CAT |
| 4083 | tRNA-Met-CAT |
| 4084 | Periplasmic thiol:disulfide interchange protein DsbA |
| 4085 | FIG00506173: hypothetical protein |
| 4086 | MG(2+) CHELATASE FAMILY PROTEIN/ComM-related protein |
| 4087 | FIG00846700: hypothetical protein |
| 4088 | Nitrogen regulatory protein P-II |
| 4089 | Ammonium transporter |
| 4090 | Stringent starvation protein A |
| 4091 | ubiquinol cytochrome C oxidoreductase, cytochrome C1 subunit |
| 4092 | Ubiquinol--cytochrome c reductase, cytochrome B subunit (EC 1.10.2.2) |
| 4093 | Ubiquinol-cytochrome C reductase iron-sulfur subunit (EC 1.10.2.2) |
| 4094 | FIG137478: Hypothetical protein YbgI |
| 4095 | Heat shock protein 60 family chaperone GroEL |
| 4096 | Heat shock protein 60 family co-chaperone GroES |
| 4097 | Undecaprenyl-phosphate N-acetylglucosaminyl 1-phosphate transferase (EC 2.7.8.—) |
| 4098 | hypothetical protein |
| 4099 | Glucose-1-phosphate cytidylyltransferase (EC 2.7.7.33) |
| 4100 | Similar to CDP-glucose 4,6-dehydratase (EC 4.2.1.45) |
| 4101 | CDP-4-dehydro-6-deoxy-D-glucose 3-dehydratase (EC 4.2.1.—) |
| 4102 | Aminotransferase, DegT/DnrJ/EryC1/StrS family |
| 4103 | Transketolase, N-terminal section (EC 2.2.1.1) |
| 4104 | Transketolase, C-terminal section (EC 2.2.1.1) |
| 4105 | conserved hypothetical protein-putative transmembrane protein |
| 4106 | Putative glycosyl transferase WbaR |
| 4107 | ADP-heptose--lipooligosaccharide heptosyltransferase II (EC 2.4.1.—) |

TABLE 19-continued

| SEQ ID NO. | function |
|---|---|
| 4108 | ADP-heptose--LPS heptosyltransferase II (EC 2.—.—.—) |
| 4109 | Galactoside O-acetyltransferase |
| 4110 | Rhamnosyl transferase |
| 4111 | hypothetical protein |
| 4112 | Lipid carrier: UDP-N-acetylgalactosaminyltransferase (EC 2.4.1.—)/Alpha-1,3-N-acetylgalactosamine transferase PgIA (EC 2.4.1.—); Putative glycosyltransferase |
| 4113 | hypothetical protein |
| 4114 | hypothetical protein |
| 4115 | hypothetical protein |
| 4116 | UDP-N-acetylglucosamine 4,6-dehydratase (EC 4.2.1.—) |
| 4117 | Lipid carrier: UDP-N-acetylgalactosaminyltransferase (EC 2.4.1.—) |
| 4118 | Glutamate synthase [NADPH] small chain (EC 1.4.1.13) |
| 4119 | Glutamate synthase [NADPH] large chain (EC 1.4.1.13) |
| 4120 | Cardiolipin synthetase (EC 2.7.8.—) |
| 4121 | hypothetical protein |
| 4122 | Arginine decarboxylase (EC 4.1.1.19); Ornithine decarboxylase (EC 4.1.1.17); Lysine decarboxylase (EC 4.1.1.18) |
| 4123 | hypothetical protein |
| 4124 | hypothetical protein |
| 4125 | Putative threonine efflux protein |
| 4126 | acetyltransferase, GNAT family, putative |
| 4127 | Ferredoxin--NADP(+) reductase (EC 1.18.1.2) |
| 4128 | hypothetical protein |
| 4129 | Isoaspartyl aminopeptidase (EC 3.4.19.5) @ Asp-X dipeptidase |
| 4130 | Enoyl-[acyl-carrier-protein] reductase [FMN] (EC 1.3.1.9) |
| 4131 | Methionine gamma-lyase (EC 4.4.1.11) |
| 4132 | hypothetical protein |
| 4133 | Long-chain-fatty-acid--CoA ligase (EC 6.2.1.3) |
| 4134 | Amino acid ABC transporter, permease protein |
| 4135 | probable amino acid ABC transporter, periplasmic-binding protein |
| 4136 | Tyrosine-protein kinase Wzc (EC 2.7.10.2) |
| 4137 | GTP-binding and nucleic acid-binding protein YchF |
| 4138 | Peptidyl-tRNA hydrolase (EC 3.1.1.29) |
| 4139 | LSU ribosomal protein L25p |
| 4140 | Ribose-phosphate pyrophosphokinase (EC 2.7.6.1) |
| 4141 | tRNA-Gln-TTG |
| 4142 | 4-diphosphocytidyl-2-C-methyl-D-erythritol kinase (EC 2.7.1.148) |
| 4143 | Outer membrane lipoprotein LolB |
| 4144 | FIG140336: TPR domain protein |
| 4145 | Formamidopyrimidine-DNA glycosylase (EC 3.2.2.23) |
| 4146 | 1-acyl-sn-glycerol-3-phosphate acyltransferase (EC 2.3.1.51) |
| 4147 | putative periplasmic protein |
| 4148 | putative periplasmic protein |
| 4149 | Probable poly(beta-D-mannuronate) O-acetylase (EC 2.3.1.—) |
| 4150 | Bis(5'-nucleosyl)-tetraphosphatase, symmetrical (EC 3.6.1.41) |
| 4151 | ATP-dependent DNA helicase Rep |
| 4152 | probable cytochrome c5 |
| 4153 | tRNA-Arg-CCG |
| 4154 | hypothetical protein |
| 4155 | ABC transporter, ATP-binding/permease protein |
| 4156 | hypothetical protein |
| 4157 | hypothetical protein |
| 4158 | Exodeoxyribonuclease V alpha chain (EC 3.1.11.5) |
| 4159 | hypothetical protein |
| 4160 | UDP-galactose-lipid carrier transferase (EC 2.—.—.—) |
| 4161 | Exodeoxyribonuclease V beta chain (EC 3.1.11.5) |
| 4162 | Exodeoxyribonuclease V gamma chain (EC 3.1.11.5) |
| 4163 | hypothetical protein |
| 4164 | Type IV pilus biogenesis protein PilE |
| 4165 | hypothetical protein |
| 4166 | hypothetical protein |
| 4167 | hypothetical protein |
| 4168 | hypothetical protein |
| 4169 | Putative lipid carrier protein |
| 4170 | hypothetical protein |
| 4171 | Transcriptional regulator, LysR family |
| 4172 | transcriptional activator, LuxR/UhpA family of regulators. |
| 4173 | Succinate-semialdehyde dehydrogenase [NAD] (EC 1.2.1.24); Succinate-semialdehyde dehydrogenase [NADP+] (EC 1.2.1.16) |
| 4174 | hypothetical protein |
| 4175 | GNAT family acetyltransferase PA5433 |
| 4176 | Acetyltransferase, GNAT family |
| 4177 | hypothetical protein |
| 4178 | Transcriptional regulator, GntR family domain |
| 4179 | Purine nucleoside phosphorylase (EC 2.4.2.1) |
| 4180 | 5S RNA |

TABLE 19-continued

| SEQ ID NO. | function |
|---|---|
| 4181 | 5S RNA |
| 4182 | Long-chain-fatty-acid--CoA ligase (EC 6.2.1.3) |
| 4183 | GII3516 protein |
| 4184 | dioxygenase, TauD/TfdA |
| 4185 | FIG00454024: hypothetical protein |
| 4186 | FIG00453797: hypothetical protein |
| 4187 | tRNA-Met-CAT |
| 4188 | tRNA-Met-CAT |
| 4189 | COG1565: Uncharacterized conserved protein |
| 4190 | FolM Alternative dihydrofolate reductase 1 |
| 4191 | tRNA(Cytosine32)-2-thiocytidine synthetase |
| 4192 | Spermidine synthase-like protein |
| 4193 | UDP-glucose dehydrogenase (EC 1.1.1.22) |
| 4194 | PUTATIVE TRANSMEMBRANE PROTEIN |
| 4195 | Oxidoreductase (EC 1.1.1.—) |
| 4196 | FIG00677593: hypothetical protein |
| 4197 | Probable acetyltransferase |
| 4198 | UDP-4-amino-4-deoxy-L-arabinose--oxoglutarate aminotransferase (EC 2.6.1.—) |
| 4199 | O-antigen flippase Wzx |
| 4200 | Galactoside O-acetyltransferase (EC 2.3.1.18) |
| 4201 | Dolichol-phosphate mannosyltransferase (EC 2.4.1.83) in lipid-linked oligosaccharide synthesis cluster |
| 4202 | Unknown, probable lipopolysaccharide biosynthesis protein |
| 4203 | hypothetical protein |
| 4204 | probable glycosyltransferase |
| 4205 | Bacillosamine/Legionaminic acid biosynthesis aminotransferase PglE; 4-keto-6-deoxy-N-Acetyl-D-hexosaminyl-(Lipid carrier) aminotransferase |
| 4206 | Lipid carrier: UDP-N-acetylgalactosaminyltransferase (EC 2.4.1.—) |
| 4207 | hypothetical protein |
| 4208 | Nucleoside-diphosphate sugar epimerase/dehydratase |
| 4209 | hypothetical protein |
| 4210 | hypothetical protein |
| 4211 | Transcriptional regulator |
| 4212 | Aspartate ammonia-lyase (EC 4.3.1.1) |
| 4213 | hypothetical protein |
| 4214 | hypothetical protein |
| 4215 | hypothetical protein |
| 4216 | EpiH/GdmH-related protein |
| 4217 | hypothetical protein |
| 4218 | hypothetical protein |
| 4219 | hypothetical protein |
| 4220 | hypothetical protein |
| 4221 | Conserved hypothetical protein (perhaps related to histidine degradation) |
| 4222 | 3-polyprenyl-4-hydroxybenzoate carboxy-lyase (EC 4.1.1.—) |
| 4223 | Outer membrane protein W precursor |
| 4224 | Putrescine transport ATP-binding protein PotA (TC 3.A.1.11.1) |
| 4225 | Spermidine Putrescine ABC transporter permease component PotB (TC 3.A.1.11.1) |
| 4226 | Spermidine Putrescine ABC transporter permease component potC (TC_3.A.1.11.1) |
| 4227 | ABC transporter, periplasmic spermidine putrescine-binding protein PotD (TC 3.A.1.11.1) |
| 4228 | Small Subunit Ribosomal RNA; ssuRNA; SSU rRNA |
| 4229 | Small Subunit Ribosomal RNA; ssuRNA; SSU rRNA |
| 4230 | Small Subunit Ribosomal RNA; ssuRNA; SSU rRNA |
| 4231 | Small Subunit Ribosomal RNA; ssuRNA; SSU rRNA |
| 4232 | SSU ribosomal protein S10p (S20e) |
| 4233 | LSU ribosomal protein L3p (L3e) |
| 4234 | LSU ribosomal protein L4p (L1e) |
| 4235 | LSU ribosomal protein L23p (L23Ae) |
| 4236 | conserved hypothetical protein |
| 4237 | LSU ribosomal protein L22p (L17e) |
| 4238 | SSU ribosomal protein S3p (S3e) |
| 4239 | LSU ribosomal protein L16p (L10e) |
| 4240 | LSU ribosomal protein L29p (L35e) |
| 4241 | SSU ribosomal protein S17p (S11e) |
| 4242 | hypothetical protein |
| 4243 | LSU ribosomal protein L24p (L26e) |
| 4244 | LSU ribosomal protein L5p (L11e) |
| 4245 | SSU ribosomal protein S14p (S29e) @ SSU ribosomal protein S14p (S29e), zinc-independent |
| 4246 | SSU ribosomal protein S8p (S15Ae) |
| 4247 | LSU ribosomal protein L6p (L9e) |
| 4248 | LSU ribosomal protein L18p (L5e) |
| 4249 | SSU ribosomal protein S5p (S2e) |
| 4250 | LSU ribosomal protein L30p (L7e) |
| 4251 | LSU ribosomal protein L15p (L27Ae) |
| 4252 | Preprotein translocase secY subunit (TC 3.A.5.1.1) |

TABLE 19-continued

| SEQ ID NO. | function |
|---|---|
| 4253 | hypothetical protein |
| 4254 | SSU ribosomal protein S4p (S9e) |
| 4255 | DNA-directed RNA polymerase alpha subunit (EC 2.7.7.6) |
| 4256 | LSU ribosomal protein L17p |
| 4257 | Glutaminase (EC 3.5.1.2) |
| 4258 | Flavodoxin reductases (ferredoxin-NADPH reductases) family 1 |
| 4259 | hypothetical protein |
| 4260 | probable methyl-accepting chemotaxis protein |
| 4261 | hypothetical protein |
| 4262 | Apolipoprotein N-acyltransferase (EC 2.3.1.—)/Copper homeostasis protein CutE |
| 4263 | Magnesium and cobalt efflux protein CorC |
| 4264 | Metal-dependent hydrolase YbeY, involved in rRNA and/or ribosome maturation and assembly |
| 4265 | Phosphate starvation-inducible ATPase PhoH with RNA binding motif |
| 4266 | hypothetical protein |
| 4267 | hypothetical protein |
| 4268 | tRNA-i(6)A37 methylthiotransferase |
| 4269 | hypothetical protein |
| 4270 | POTASSIUM/PROTON ANTIPORTER ROSB |
| 4271 | hypothetical protein |
| 4272 | tRNA pseudouridine synthase A (EC 4.2.1.70) |
| 4273 | hypothetical protein |
| 4274 | Flagellar protein FlgJ [peptidoglycan hydrolase] (EC 3.2.1.—) |
| 4275 | hypothetical protein |
| 4276 | Transcriptional regulator, AraC family |
| 4277 | hoxX-like protein |
| 4278 | Acyl-CoA dehydrogenase (EC 1.3.99.3) |
| 4279 | Ornithine cyclodeaminase (EC 4.3.1.12) |
| 4280 | Ornithine cyclodeaminase (EC 4.3.1.12) |
| 4281 | hypothetical protein |
| 4282 | Adenylylsulfate kinase (EC 2.7.1.25) |
| 4283 | MFS permease |
| 4284 | hypothetical protein |
| 4285 | nonribosomal peptide synthetase |
| 4286 | tRNA-Tyr-GTA |
| 4287 | tRNA-Gly-TCC |
| 4288 | tRNA-Thr-GGT |
| 4289 | Translation elongation factor Tu |
| 4290 | tRNA-Trp-CCA |
| 4291 | Preprotein translocase subunit SecE (TC 3.A.5.1.1) |
| 4292 | Transcription antitermination protein NusG |
| 4293 | LSU ribosomal protein L11p (L12e) |
| 4294 | LSU ribosomal protein L1p (L10Ae) |
| 4295 | tRNA-Thr-GGT |
| 4296 | LSU ribosomal protein L10p (P0) |
| 4297 | LSU ribosomal protein L7/L12 (P1/P2) |
| 4298 | DNA-directed RNA polymerase beta subunit (EC 2.7.7.6) |
| 4299 | DNA-directed RNA polymerase beta' subunit (EC 2.7.7.6) |
| 4300 | SSU ribosomal protein S12p (S23e) |
| 4301 | SSU ribosomal protein S7p (S5e) |
| 4302 | hypothetical protein |
| 4303 | Translation elongation factor G |
| 4304 | translation elongation factor Tu (EC: 3.6.1.48) |
| 4305 | hypothetical protein |
| 4306 | hypothetical protein |
| 4307 | hypothetical protein |
| 4308 | HrgA protein |
| 4309 | Type I restriction-modification system, DNA-methyltransferase subunit M (EC 2.1.1.72) |
| 4310 | Putative DNA-binding protein in cluster with Type I restriction-modification system |
| 4311 | Anticodon nuclease |
| 4312 | Type I restriction-modification system, specificity subunit S (EC 3.1.21.3) |
| 4313 | Type I restriction-modification system, restriction subunit R (EC 3.1.21.3) |
| 4314 | DNA gyrase subunit B (EC 5.99.1.3) |
| 4315 | DNA polymerase III beta subunit (EC 2.7.7.7) |
| 4316 | Chromosomal replication initiator protein DnaA |
| 4317 | hypothetical protein |
| 4318 | LSU ribosomal protein L34p |
| 4319 | Ribonuclease P protein component (EC 3.1.26.5) |
| 4320 | Protein YidD |
| 4321 | Inner membrane protein translocase component YidC, long form |
| 4322 | hypothetical protein |
| 4323 | GTPase and tRNA-U34 5-formylation enzyme TrmE |
| 4324 | hypothetical protein |
| 4325 | probable sensor/response regulator hybrid |
| 4326 | ADA regulatory protein/Methylated-DNA--protein-cysteine methyltransferase (EC 2.1.1.63) |

TABLE 19-continued

| SEQ ID NO. | function |
| --- | --- |
| 4327 | Probable carboxyvinyl-carboxyphosphonate phosphorylmutase (EC 2.7.8.23) |
| 4328 | Osmoprotectant ABC transporter inner membrane protein YehW |
| 4329 | L-proline glycine betaine ABC transport system permease protein ProV (TC 3.A.1.12.1) |
| 4330 | Putative ABC transport integral membrane subunit |
| 4331 | probable ABC transporter |
| 4332 | Transcriptional regulatory protein algP |
| 4333 | Putative capsular polysaccharide transport protein YegH |
| 4334 | Cytochrome c-type biogenesis protein CcsA/ResC |
| 4335 | Cytochrome c-type biogenesis protein Ccs1/ResB |
| 4336 | Cytochrome c4 |
| 4337 | GTP-binding protein EngB |
| 4338 | Rare lipoprotein A precursor |
| 4339 | Competence protein F homolog, phosphoribosyltransferase domain; protein YhgH required for utilization of DNA as sole source of carbon and energy |
| 4340 | Biotin synthase (EC 2.8.1.6) |
| 4341 | 8-amino-7-oxononanoate synthase (EC 2.3.1.47) |
| 4342 | Sensory box/GGDEF family protein |
| 4343 | putative phosphatidylethanolamine N-methyltransferase |
| 4344 | Biotin synthesis protein bioH |
| 4345 | Biotin synthesis protein BioC |
| 4346 | acetyltransferase, GNAT family |
| 4347 | UPF0028 protein YchK |
| 4348 | Glutathione S-transferase family protein |
| 4349 | Sterol desaturase |
| 4350 | Putative exported protein |
| 4351 | Aromatic amino acid transport protein AroP |
| 4352 | hypothetical protein |
| 4353 | Sodium-dependent transporter |
| 4354 | hypothetical protein |
| 4355 | FIG006238: AzlC family protein |
| 4356 | Transcriptional regulator, AraC family |
| 4357 | hypothetical protein |
| 4358 | hypothetical protein |
| 4359 | Copper metallochaperone, bacterial analog of Cox17 protein |
| 4360 | DNA polymerase IV (EC 2.7.7.7) |
| 4361 | Rod shape-determining protein RodA |
| 4362 | Penicillin-binding protein 2 (PBP-2) |
| 4363 | Rod shape-determining protein MreD |
| 4364 | Rod shape-determining protein MreC |
| 4365 | Rod shape-determining protein MreB |
| 4366 | Aspartyl-tRNA(Asn) amidotransferase subunit C (EC 6.3.5.6) @ Glutamyl-tRNA(Gln) amidotransferase subunit C (EC 6.3.5.7) |
| 4367 | Aspartyl-tRNA(Asn) amidotransferase subunit A (EC 6.3.5.6) @ Glutamyl-tRNA(Gln) amidotransferase subunit A (EC 6.3.5.7) |
| 4368 | Aspartyl-tRNA(Asn) amidotransferase subunit B (EC 6.3.5.6) @ Glutamyl-tRNA(Gln) amidotransferase subunit B (EC 6.3.5.7) |
| 4369 | Cell division protein MraZ |
| 4370 | rRNA small subunit methyltransferase H |
| 4371 | Cell division protein FtsL |
| 4372 | Cell division protein FtsI [Peptidoglycan synthetase] (EC 2.4.1.129) |
| 4373 | UDP-N-acetylmuramoylalanyl-D-glutamate--2,6-diaminopimelate ligase (EC 6.3.2.13) |
| 4374 | UDP-N-acetylmuramoylalanyl-D-glutamyl-2,6-diaminopimelate--D-alanyl-D-alanine ligase (EC 6.3.2.10) |
| 4375 | Phospho-N-acetylmuramoyl-pentapeptide-transferase (EC 2.7.8.13) |
| 4376 | UDP-N-acetylmuramoylalanine--D-glutamate ligase (EC 6.3.2.9) |
| 4377 | Cell division protein FtsW |
| 4378 | UDP-N-acetylglucosamine--N-acetylmuramyl-(pentapeptide) pyrophosphoryl-undecaprenol N-acetylglucosamine transferase (EC 2.4.1.227) |
| 4379 | UDP-N-acetylmuramate--alanine ligase (EC 6.3.2.8) |
| 4380 | D-alanine--D-alanine ligase (EC 6.3.2.4) |
| 4381 | Cell division protein FtsQ |
| 4382 | Cell division protein FtsA |
| 4383 | Cell division protein FtsZ (EC 3.4.24.—) |
| 4384 | UDP-3-O-[3-hydroxymyristoyl] N-acetylglucosamine deacetylase (EC 3.5.1.—) |
| 4385 | hypothetical protein |
| 4386 | molybdenum cofactor biosynthesis protein C |
| 4387 | hypothetical protein |
| 4388 | putative periplasmic protein |
| 4389 | COG3332 |
| 4390 | Molybdopterin biosynthesis MoeB protein |
| 4391 | Dihydroorotase (EC 3.5.2.3) |
| 4392 | hypothetical protein |
| 4393 | Oligopeptide ABC transporter, periplasmic oligopeptide-binding protein OppA (TC 3.A.1.5.1) |
| 4394 | Oligopeptide transport system permease protein OppB (TC 3.A.1.5.1) |
| 4395 | Oligopeptide transport system permease protein OppC (TC 3.A.1.5.1) |

TABLE 19-continued

| SEQ ID NO. | function |
|---|---|
| 4396 | Oligopeptide transport system permease protein OppB (TC 3.A.1.5.1) |
| 4397 | Oligopeptide transport ATP-binding protein OppF (TC 3.A.1.5.1) |
| 4398 | hypothetical protein |
| 4399 | COG2045: Phosphosulfolactate phosphohydrolase and related enzymes |
| 4400 | PlcB, ORFX, ORFP, ORFB, ORFA, Idh gene |
| 4401 | hypothetical protein |
| 4402 | Phenylacetate-coenzyme A ligase (EC 6.2.1.30) |
| 4403 | Phenylacetate-coenzyme A ligase (EC 6.2.1.30) |
| 4404 | rfbN protein |
| 4405 | Multidrug translocase MdfA |
| 4406 | CDP-diacylglycerol pyrophosphatase (EC 3.6.1.26) |
| 4407 | Glyoxalase family protein |
| 4408 | Molybdopterin biosynthesis MoeB protein |
| 4409 | hypothetical protein |
| 4410 | hypothetical protein |
| 4411 | Transcriptional regulator, TetR family |
| 4412 | Low-specificity L-threonine aldolase (EC 4.1.2.5) |
| 4413 | periplasmic binding protein, putative |
| 4414 | hypothetical protein |
| 4415 | Prolyl endopeptidase (EC 3.4.21.26) |
| 4416 | hypothetical protein |
| 4417 | probable metallopeptidase |
| 4418 | hypothetical protein |
| 4419 | hypothetical protein |
| 4420 | Glycine betaine transporter OpuD |
| 4421 | RNA binding methyltransferase FtsJ like |
| 4422 | Universal stress protein UspA and related nucleotide-binding proteins |
| 4423 | glutamine synthetase family protein |
| 4424 | methyl-accepting chemotaxis protein III (MCP-III) |
| 4425 | hypothetical protein |
| 4426 | hypothetical protein |
| 4427 | hypothetical protein |
| 4428 | hypothetical protein |
| 4429 | Gamma-glutamyl phosphate reductase (EC 1.2.1.41) |
| 4430 | Small-conductance mechanosensitive channel |
| 4431 | major facilitator superfamily MFS_1 |
| 4432 | putative beta-ketoadipate enol-lactone hydrolase (EC: 3.1.1.24) |
| 4433 | Transcriptional regulator, MarR family |
| 4434 | hypothetical protein |
| 4435 | probable acid phosphatase |
| 4436 | hypothetical protein |
| 4437 | Zn-ribbon-containing, possibly RNA-binding protein and truncated derivatives |
| 4438 | ABC-type nitrate/sulfonate/bicarbonate transport system, ATPase component |
| 4439 | ABC-type anion transport system, duplicated permease component |
| 4440 | phosphodiesterase I |
| 4441 | Protein export cytoplasm protein SecA ATPase RNA helicase (TC 3.A.5.1.1) |
| 4442 | Undecaprenyl-phosphate N-acetylglucosaminyl 1-phosphate transferase (EC 2.7.8.—) |
| 4443 | thioredoxin-related transmembrane protein |
| 4444 | putative carbohydrate kinase |
| 4445 | Glutamate--cysteine ligase (EC 6.3.2.2), divergent, of Alpha- and Beta-proteobacteria type |
| 4446 | Large tegument protein |
| 4447 | Glutathione synthetase (EC 6.3.2.3) |
| 4448 | Diacylglycerol kinase (EC 2.7.1.107) |
| 4449 | protein of unknown function DUF1622 |
| 4450 | hypothetical protein |
| 4451 | DNA topoisomerase I (EC 5.99.1.2) |
| 4452 | Protein of unknown function Smg |
| 4453 | Rossmann fold nucleotide-binding protein Smf possibly involved in DNA uptake |
| 4454 | Uncharacterized protein with LysM domain, COG1652 |
| 4455 | hypothetical protein |
| 4456 | Peptide deformylase (EC 3.5.1.88) |
| 4457 | Methionyl-tRNA formyltransferase (EC 2.1.2.9) |
| 4458 | Peptidase M48, Ste24p precursor |
| 4459 | Ribosomal RNA small subunit methyltransferase B (EC 2.1.1.—) |
| 4460 | Probable proline rich signal peptide protein |
| 4461 | Nitrogen regulation protein NtrY (EC 2.7.3.—) |
| 4462 | Nitrogen regulation protein NtrX |
| 4463 | Sulfur carrier protein adenylyltransferase ThiF |
| 4464 | thioredoxin family protein |
| 4465 | 4-hydroxybenzoyl-CoA thioesterase family active site |
| 4466 | hypothetical protein |
| 4467 | probable TonB protein |
| 4468 | Non-specific DNA-binding protein Dps/Iron-binding ferritin-like antioxidant protein/ Ferroxidase (EC 1.16.3.1) |
| 4469 | UPF0235 protein VC0458 |

TABLE 19-continued

| SEQ ID NO. | function |
|---|---|
| 4470 | hypothetical protein |
| 4471 | Periplasmic divalent cation tolerance protein CutA |
| 4472 | hypothetical protein |
| 4473 | tRNA-Lys-TTT |
| 4474 | tRNA-Lys-CTT |
| 4475 | tRNA-Lys-CTT |
| 4476 | tRNA-Lys-TTT |
| 4477 | tRNA-Lys-CTT |
| 4478 | tRNA-Lys-TTT |
| 4479 | tRNA-Lys-CTT |
| 4480 | tRNA-Lys-TTT |
| 4481 | Heme oxygenase HemO, associated with heme uptake |
| 4482 | Potassium-transporting ATPase A chain (EC 3.6.3.12) (TC 3.A.3.7.1) |
| 4483 | hypothetical protein |
| 4484 | hypothetical protein |
| 4485 | Orotate phosphoribosyltransferase (EC 2.4.2.10) |
| 4486 | Exodeoxyribonuclease III (EC 3.1.11.2) |
| 4487 | hypothetical protein |
| 4488 | Thiosulfate sulfurtransferase, rhodanese (EC 2.8.1.1) |
| 4489 | hypothetical protein |
| 4490 | Diadenosine tetraphosphate (Ap4A) hydrolase and other HIT family hydrolases |
| 4491 | Putative membrane protein |
| 4492 | probable acid shock protein |
| 4493 | hypothetical protein |
| 4494 | Chitinase (EC 3.2.1.14) |
| 4495 | Isochorismatase (EC 3.3.2.1) |
| 4496 | D-3-phosphoglycerate dehydrogenase (EC 1.1.1.95) |
| 4497 | probable GGDEF family protein |
| 4498 | Transcriptional regulator, MerR family |
| 4499 | FAD/FMN-containing dehydrogenases |
| 4500 | 4-hydroxythreonine-4-phosphate dehydrogenase (EC 1.1.1.262) |
| 4501 | Survival protein SurA precursor (Peptidyl-prolyl cis-trans isomerase SurA) (EC 5.2.1.8) |
| 4502 | Outer membrane protein Imp, required for envelope biogenesis/Organic solvent tolerance protein precursor |
| 4503 | COG3178: Predicted phosphotransferase related to Ser/Thr protein kinases |
| 4504 | hypothetical protein |
| 4505 | Glucose-1-phosphate thymidylyltransferase (EC 2.7.7.24) |
| 4506 | Crossover junction endodeoxyribonuclease RuvC (EC 3.1.22.4) |
| 4507 | Holliday junction DNA helicase RuvA |
| 4508 | hypothetical protein |
| 4509 | Putative sensory histidine kinase YfhA |
| 4510 | hypothetical protein |
| 4511 | Putative sensor-like histidine kinase YfhK |
| 4512 | Riboflavin synthase eubacterial/eukaryotic (EC 2.5.1.9) |
| 4513 | 3,4-dihydroxy-2-butanone 4-phosphate synthase (EC 4.1.99.12) |
| 4514 | Holliday junction DNA helicase RuvB |
| 4515 | hypothetical protein; putative membrane protein |
| 4516 | hypothetical protein |
| 4517 | ABC transporter, periplasmic spermidine putrescine-binding protein PotD (TC 3.A.1.11.1) |
| 4518 | Glutamate 5-kinase (EC 2.7.2.11)/RNA-binding C-terminal domain PUA |
| 4519 | hypothetical protein |
| 4520 | Adenosylmethionine-8-amino-7-oxononanoate aminotransferase (EC 2.6.1.62) |
| 4521 | Type IV pilin PilA |
| 4522 | Type IV pilin PilA |
| 4523 | Possible integral membrane protein |
| 4524 | Possible integral membrane protein |
| 4525 | RNA polymerase sigma factor RpoH |
| 4526 | Cell division protein FtsX |
| 4527 | Cell division transporter, ATP-binding protein FtsE (TC 3.A.5.1.1) |
| 4528 | Signal recognition particle receptor protein FtsY (=alpha subunit) (TC 3.A.5.1.1) |
| 4529 | Ribosomal RNA small subunit methyltransferase D (EC 2.1.1.—) |
| 4530 | 4Fe—4S ferredoxin, iron-sulfur binding |
| 4531 | tRNA-Tyr-GTA |
| 4532 | tRNA-Gly-TCC |
| 4533 | tRNA-Thr-GGT |

SEQUENCE LISTING (8961 sequences)

SEQ ID NO: 1 - DNA, 4705025 bp, Chromobacterium substugae (residues 1-1,568,342 of 4,705,025)
  modified_base (5)..(5): a, c, t, g, unknown or other
  modified_base (7)..(7): a, c, t, g, unknown or other
  modified_base (20)..(20): a, c, t, g, unknown or other
  modified_base (380784)..(380784): a, c, t, g, unknown or other
  modified_base (398396)..(398396): a, c, t, g, unknown or other
  modified_base (453151)..(453151): a, c, t, g, unknown or other
  modified_base (500151)..(500151): a, c, t, g, unknown or other
  modified_base (808684)..(808684): a, c, t, g, unknown or other
  modified_base (916888)..(916888): a, c, t, g, unknown or other
  modified_base (1139584)..(1139584): a, c, t, g, unknown or other
  modified_base (1271431)..(1271431): a, c, t, g, unknown or other
  modified_base (1293924)..(1293924): a, c, t, g, unknown or other
  modified_base (1514851)..(1514851): a, c, t, g, unknown or other
  modified_base (1516434)..(1516434): a, c, t, g, unknown or other
  modified_base (1528711)..(1528711): a, c, t, g, unknown or other
  modified_base (1672252)..(1672252): a, c, t, g, unknown or other
  modified_base (1824790)..(1824790): a, c, t, g, unknown or other
  modified_base (2147963)..(2147963): a, c, t, g, unknown or other
  modified_base (2153200)..(2153304): a, c, t, g, unknown or other
  modified_base (2158890)..(2158890): a, c, t, g, unknown or other
  modified_base (2292853)..(2292853): a, c, t, g, unknown or other
  modified_base (2361816)..(2361816): a, c, t, g, unknown or other
  modified_base (2370011)..(2370011): a, c, t, g, unknown or other
  modified_base (2474461)..(2474507): a, c, t, g, unknown or other
  modified_base (2989447)..(2989447): a, c, t, g, unknown or other
  modified_base (3032640)..(3032640): a, c, t, g, unknown or other
  modified_base (3106965)..(3106965): a, c, t, g, unknown or other
  modified_base (3170939)..(3170939): a, c, t, g, unknown or other
  modified_base (3246515)..(3246515): a, c, t, g, unknown or other
  modified_base (3352429)..(3352429): a, c, t, g, unknown or other
  modified_base (3816903)..(3816903): a, c, t, g, unknown or other
  modified_base (4217325)..(4217325): a, c, t, g, unknown or other
  modified_base (4230954)..(4230954): a, c, t, g, unknown or other
  modified_base (4357679)..(4357679): a, c, t, g, unknown or other
  modified_base (4403286)..(4403286): a, c, t, g, unknown or other
  modified_base (4450659)..(4450659): a, c, t, g, unknown or other
  modified_base (4468392)..(4468392): a, c, t, g, unknown or other
mrsdnsncchrmbactrmgnmcggctggcggccgccagccgccatatcgtggtggcggccgaataccggctggcgccggaaaacccctacccggccggcctgaacgacgccgccagcgtggtgaagggcgtgtgggatgtgctggatgaacgccggctgccctatcgcaggcagctggcgctggccggcgattcggccggcggcgcgctatgcgccagcctgagcggcaaggctgcggctgacggcgccgagccgggcatcgcccgccaggtgttgatctacccttgcgtcgattacacgctggcccagccatcggtggccgagaacggcgacggctattttctcaccgccaatcgcaccgagtggtatttcgaccagtacttccagcatgacgaggatcgccgccaagcctcgccgctgtattggccagccgcgccgaatccgcccgccacgctgctgatcaccgccggacgcgacccgctgcgcgaccagggcctgcaatacggcaaccagctgaaagccgccggcgcccaggtcgagcagctgcacctggacgaccagatgcacgcctttctcaacatggaggcgctggtgccggaggtgtgccagctggtctaccgccgcatcggtgcctttctcaacgccgaatgacacacccgccccggcgacgctgaagcgggtcagcttcgacgcgccgcgcggcggcgggcatcatcgcctcaatagttttccgggaagaagtggcgctcggtcagctcgatcaggatgtgcagcaccttgatgtgcagttcctgcacccggtcggcgtactggccgccgggggtgttgacgtaaacgtcggccagcggctccagcttggtgccggcgcggccggtgaggatgatcaccttgacccccaattcgcgcgcggtttcggcggcgcggacgatgttgcggctgttgccgctggtgctcagccccagcagcacgtcgccggcgcgggcgtggctttccaggtagcgggcgaagatctcgtcgtaaccgtagtcgttgcccacgcagctgatgtggctggggtcgctgatggcgatggcggccatgccgcggcggttattgcggtagcggccggtcagttcctcggcgaagtgcatcgcgtcgcacatcgagccgccgttgccgcaggaaaacacccggccgcccgcttccagcgcggcgatgatggccgcgcccgcggcctcgatgccggccaacgcctcggcattgtccagcaggttgtcgagcgccgacttggcctcgctgaggctggcgtggatatgtgatttcatagcggttgcggtctccagtatcagcttgtcagtttacttcatcgcgccgggaggcggcgctcaggcgatctgcctgccgaaccacaccacccggccgatgacctcgaattccccggcggcgcgcgccaggtccacggtaaaggtttcatacagcggattggcgctcttcacctgcaccgcgccgcccggcagccgctgcagctgcttgacgaagatgtcctcgccgatgcggatcacgaacaaaccttcgccgggatggcgttccgcggtgttgatcaggatggtgtcgcggtcttccagcacgccgctcatgctgtcgcccttgacgctgatcaccgccaggtcgcgcggcgaggcgttcaggtggtttttcacccaatagcggcgaaacgccatatagaacagcggctgttcgtcgcaggcggcggttccaaagccggccgacgccctcaggttataacgcgggatgaaacagaactcctcgcgcacgccgtccggaacgaaatgctcgtcctccgacccgcgcatcggttccaaacgcgcggcctcgaccgcgatctcttccgccgccgcgccggcagcggcatcggcctgggccggctcctcgccatggagcagccactccagccggcagccgctgctgctggcgatcttctgcgccgtggccagccgcggcacgccgcccttgtaccacatattggtgaacgaacccttgttgatgcccatgcgggccgcccaggcataaggcttttccgcaccgatcagcagttccagccgttgccggaagtcgggctgctgcaaggaattttccatatagaactccatcagaactcgatcatggccaaagccatccgtcagagtactatttcatgaacaccccgtcgactgcgactgacaccgatagtgacattccatcgcttgctcagttctaaaatacagcttaaaatggcaaccatactgcataacaagttacacaaatttaataaagtctttgtttagaaccatgatggacagggtgattactacggttccaaaacagattctacaaccggagggacgcagcgcatgccggcctctgctcgaattataactcttttagaacttcatgtctgccaaggccatttgggacccaaggagtatccgcgatgaacgctactgcgcactttcccgctcttcccgccaccatgcaactggtcgcccagctgataggcatgccgcgcaccctgcaattggtgcaggcgctgggcggcaccaccctgccgttttccaagaaccagagccgcgccggccagttgcgcttcgccgcgctggtggacgtgatcggccaggacgccgcggaactgctgacccgccacttcggcggcgacatcctctacatcccgcgctgcagccaggcgctgcgccaggcgcgcaaccagcagctgatccgcgacttcgacgcgctgctgatcgacggcctgggcgccaacgaagccgtcggcctgctggcgatgcgctaccgcctcagcgaccgcatgatctggcgcgtgctgaaaaccccgccggccccgcacgaggtgcactgattatccaccggcaaaggagtccccgcatggccagccgcgccatttccgatctgcacccgcaactgcaaccgctggccgaagcctttctgcgccgctgccgcgaccagggagtcgacccgctgctcacctgcacctggcgctccccggccgaacaggacgccctgtaccagcaaggccgcagcaagcccggccccatcgtcacccgcgcccgcgccggccagtccgcccacaacgccatgctgcacggcagcccggccgccctcgccttcgacgtggtgccgctgcaggccggcaagccggtatgggacgccgaccaccctcactggcaagtcatgggccagatcggcctggcgctgggcttgcgctggtacggcgccgccgacgcgccgtttcgcgagtatccccatttccaactgacgcaggagacatgagcatgcgcctttccgacctggtccgcggcccgcacagccgccgtctcagccatagccggctttgggccaacgtggcctgcgccgccgccaccgcgatgttcgtcgtcgacggctggcgcggcaccctcacgcccgatctgtggctgatctatctgggcgtggtgggcggctactccgcctcgctgcggctgatctccgcctatcgcggccggagcccggcatgatgcccgccgccgccctgcggctgggcgcctgtctgctcttgccgctggccgccggcgccggcggctacgcgctgggcagccagcgcagcggccaatattggcaggcccggctgcaagccagcgtttcccaactgcaagccgacgacagccgcgccgccgaacagcggcagcaagcggcgctgatgcaacagcagcaatggcgccagcgcatcgatcagctggaagacagcctgctgcggcagcaacaggcgcggcaagcgcagcaacgccaacaagcgcaaaggatagacgatgtcactcgccacgatggttccgcttttaccggccttggccctgacggcctgcgcctctaccgccagctcctcggctatcccgccgagctgcccggcgcccagcccctacctgctggaaatgccggccaagccgccggcgccggcggcgggctaccggcgcccgacctcctcgcccacgccgccgattacggcgcctggtgccaacaactggaacagcgccttgccgccctgaaacaactttacgccccacaggagcccacgccatgaccgacttcttcgaccgcgccagcgagctggaaaccgaattccgcgaacaagcgctcgcccgccatttccagcagctgcaacacggcggctacagccactgcgaggactgcggcgatcccattccgcaggcccgccgcgtcgcgctgcccagctgcacccgctgcgtgatctgccaacagttggcggaacgctgaggaggtttcacgtggaacacgacaatctgctggccctgggccgcatcgaaggcaagctggacatgatcgtcgcccacctcgccaaacaggataaaaaactggaagaactggacggccgtctgcgcgacgtggaagtccaggccgccaaaagcggcgcgctgtccggcgccctgtcggcgctgctggtcaccctggccggcgaactcctcaagcgcgcgctgcactgacaacgctcagctaagccccggcgccgccccgcctcacaatccctctcatcctctccgtcctttcaaggaagctccatgtccatgctgatctccgtgcaaaccgccatcgccgaccgcctgcgccaaggcctgggccgcatggtgcgcgaagtggcggccgacctcgacgaaaccgcgctgtgcggcctgcagctggcccacggcgactacgccagccgcctcacccccggccaggccagccccgtcatcaacacgcaggcgctggccaggctgccggcgctgtggaccgtggccggcggcatcgccgccagcacgccgcaggccagccagcgccaacgctacaaagccaacgcgcagttcaccgtcatcgtcggcgaccgcctgcaagccgatgccggctacgccggcgccggcgtctggcaactggtatacgcggtgcgccgcctgctggcctcgcaggatttcggcctggccatccagccgctgcagccggaaaaagtccgcccgctgggccagaccccgcgcgacggccagccctggagcttggtggcctgcgacttcgccacctactggctggacgaagcgctggacaacggccgctggccggcgccgcaaggcgacgccgacccggacgcgctgttccgatcctttggcggccgcctggaagacccggccaaggattggcaaagcacccagctcaactacagcctggccggcaatcccaccctcaaggcccaggacaccctcatccagcccgctcccaagccggctccgtaagcacccagtttccccgtcgccgcgccgtccggcgcggcactctcacccaaccgcagcatcaggagtcccactctcatggccagccccaacatcagcttcgaccaaattccggcatccatccgcaaaccgggcaaatacttcgagttcaacaccaagctggcggtacgcaccctgccgggcaatccgcagcgcgtgctgctgatcggccagcgcctggccgacgatccggccaatccgggcaagaacgccacccagccggcgctgtcggcgctggacgtgttcagcgacgaacaagccgcccaggccttcggccgcggttcttacgcccacctgatggcccgcgccgcgatcaacgccaatccctatctgcaactcaccgtgatcgcggttgacgacgccgccgccggcgtgccggcagccggctccttcaccttcagcggcccggccgccgccgccggcgtgatgagcctctatatcggcgccgtgcgcgtcgacgtggccgtcgccgccggcgacgacgccaccaagatcgccgccaacgcccaggccgccatcgccaagctgaccgacctgccggtaagcgccgccgccgccaaggaagtgctgaccctcaccgcccgccacaagggcggcatcggcaacggcatcgcgctgaaggcgcaggaacagatcgccggcctgaccgtggccatcgcgccgatgaagggcggcgccggcgacccggacatcgccccggcgctggccgcggtggtcagcggcggccaccagatcgtggtcaatccgttcaacaccgacgccgccctggccgcgctgcgcacccacctcgacttcgtttccggcccgctggaacagcgcggcgccatcggcgtgatcgccaccgtcggcgcgctggccgacgcggcagccctgtccgccaaactggacagcggccgcatcaccgccgcctggtatcgcggctcggccaagctgccgggcgacatcgccgccgcttacgccgcggtgctggccagcgaggaagatccggcccgtccgctcaacacgctggagctgaaaggcctggacgtggtggacctggcgtcccgcaccagccgcaccgagcaggaaagcgcgctgtacagcggcgtcaccccgctggaagtggccgccggcaaccgcgtgcagatcgtccgcgccatcagcacctacaccaaggacgcgcaaggcgtggacgacgtgtcgctgctggacatcaccaccatccgcacgctggactacgtccgccgcgcctgccgcgagcgcatcgcgctgcgcttcccgcgtgaaaagctgtccgaccgcacgccgtccaaggtgcgctccgaactgctggacgtgctgtacaagctggaagagctggaaatcatcgaacaggttgacgccaacaaggacggcctgatcgtcgagcgcgacctgcaggacgccaaccgcctggacgccaagatcccggttgacgtggtgaacggcctgcacgtgttcgccggccgcatcgacctgctgctgtaagcctctcccaccctccgccggccgggccatccggccggttccctccccgcatcgaaaaggaatatcccatggctttgaaagaatacgcaggctccatcgtcctggaagtgaacggccaggaaatcgacgtcatcgacctcaacgtcagcagcaagaccggccgcaagctggtgaagacgatgaactccagcggccgcgccaagggcttctcccgcggcgtcaccgagtacgacctgtccatcaccgtgtccatcccgctgaccggcgatctggactgggaagcgatcgaaggcgccaagctgaccgaattcccgctggccggcggcaaacgcaccagctacctcgactgcttcacgatggaagtcggcgagaaatacggcgtggaaagcgaagcgcgccgcgatatcaagctgatgtcgctgcggaaggtggtcgaataagtcgtagctggccatcgtttgatggccagctattttttatctttttttaattaattgcagaggaattgcccgctgtggtttctatcaacttaatcataaggaatttcacatatgccaattgaaaaaaaaccacaaaaggcaagcattaaaaatacctactccagaggaaaagacaagagattatctaccgacaaaacatcctctcaaaaaatagcggagacgttattctcacaggaaaattccgatccatcccctcctgaaactaagagtattttttctaatcagcaagtatcagattccaaatcgatactggagggattcctagatgcaattaccaaagaacatggggagctatccgcaccaggcgccttggcaaaagcaggaaaagacagactgaaactacttgggaatattgataatgcaaccaaagtactccagcatgttatcgctggaaacgatgatgaagctatagtccaactctccagaattattggcgaatatgctggcgataagataggtggagaaattggtggaaaactaggagcagcaggcggatccttgattggtccggagggaacggttgcaggaggaatcgcaggaggcacctatggggccatgtatggctctcaaaaaatgggtgatattgcggagcggatcgccagggaacaactcaactatgtcgtttcaaatgatgacgtgcccccaacaatagaaaaaaaagatggtggaaagtacttccttgccaagcatggtgaaaactatcaatggtatgacgccccccctcaagaggctacgcaaagtcgcagcgttggttcgctagcatcaagcaatgagaaaaaatacaagccggtaaaagatgaaaaactcacagacgagctaactcaggaatatgctgagaaaactgggtatatcaatagaagaataaaagaacagaataaaaaaaatcaagaggacagaaggaaaaatataaaaaggggcctcgctcccgatggaaaagaattcaacaagcaatataccactgacggcaaaggagtccatgccagtcaaatatgggtagaagacaaaaagaaaaaccaattgattggtgtaaataccgttgacactcaaggaaaatcgataagctcggcggattattatgacaaagaaaccggccgccatttaggaacagagactgccatcaccgaaggagggaaaacaaccaaaagcagcacattaccttccgataaaaactcaccgccctcgccaaaaccccacaaaatcagcgcaaagcccaaaaatacacccaatagcgcggacaataaaaaagaaaaaacaaattcagcaccaaacatacaaaagagaacaccgcagaaaaatacagctctaggcttgaacgagcagcaatcccctgtgcagaagggaattgccaactcgatttcccctgcaaccaattcagccacagagccgaatgccatcgaaaaagacccgaacccaaacgtagcggcggcaaccgaagaacaggtagtcaaaacacatgcctcagggcagctctcaaccgttgccgatgagatgcccgataagacgaaaacaccggcgcaagacaccacgctatcgccccacggccagaccgataaaacacaaatcccggcgccatcaaccggcggcaattcagactctcagcttgccgctctaatcgcccagctcagctcagcgcttgcacaactcactcaacccatacgcgtcgtcgtcgacgtccagcacggcaacatcatcgccgccgtcaacgccgccaacagccaacaacaaaggaggagctgatgttcagcctcaatctgtccgccggcacggccgccggctccctggtggacgccagcttccgcggcgtgcgcttcgattgcctgaaaagccaggacagcgcccagcgcgaccaggcgatgcacgaatacccgtacaaggacggggccgatgtcgaggatctgggccgcaaggcgcgcaaggtgacgctcaacgcgatgttctggggcgagggctatcaggaccggctgcgcgaattcgtcgccgcactggacgccgccggcccgggcgagctggtgcacccggtgttcggcagcatgccgcaggcccaggtgctggactaccagatcagccacgacgccgacgcgcccgactcctgcgccgtggacatcaactgggtggaggccacgccgggcaatcccttcttcgcgcagcacaagccgctgcagcagagcgaagccatcgacgccaaggtggacgagctgcgcggcatggccggcgaagcctacgccaaagcccaggaactggtcgccaccgccaagggcgcgctggccaggctgggcgcgctgcgccagcagctggtcgccacggtgaaggcgctggccgacatggccaaccaggcggtggcccaggtcaacgacctgctggcctatccgcaagccttcgtcagcgaggtgaacggactggtggaccaggtggccgactggaaattcgaccaggcgctggacctgggcccgctgccggcgttgaaaaccgccgccagcctgcccgccgccaccctggccgactggaatgcgctgcggcgccggctggacggcctgccggagcggatacgccagaacaccacgccgctcaccgccagcgccgccctcaccgtgtggagcagcgaccagcagcggatagacgcgctgctgcagctgaacgtcgccaccaagctggccagcgccgccagcggcatcttcggcagcgaggccgagcggccgacgctgacgccgccggcgctggagcagatcgccggcgacgtgcgcggctcgctgcaaaccgccatcgaccaatggcgcgccaatatgccggccgacgccgcctaccgcgtggtggacagcctgcgcgagctgggcctgcaggtgcagcagggcgccgccggcctgatcgccgccaagccgccgctgatcgaacgcgcggtggaagccgaagccaacctgcgccagctggcccacctgtggtacggcgacagcggccgcgccgacgagctgctgcggctcaacccgcagctggcctatcccaaccacctgactccggggaccgtgatccatggctacgcccgctaaacccgccgcggcggaccacgccgtcagcctgcagatcgccggccgccgccacagcgactggacccactattcgatcgactccgacctcgccgtgcccgccgacggctggcaagtggcgctgggcctgcccggcggcgtctttccgccggaagtggagccgggcgcgatgatccaggtgcaggtgggcgcggaaaccgtgctgatgggccgggtggacgacatcagccacagcgtcgccgccggcagccaccaactggcgctgtccggccgcgacctcgccggcatgctgctcgattgcagcgcgccgctgctcaccgccaagaacatgacgctgcgcgacgtgctggaaaacgtggtgaagccgctgggcatcgcccggatacgggtggacgccaaaggcagccggccgctggaaaaaatcagcgtggaccccggcaacagcgcctgggacgtgctcacccgcgccgcccaggccaacggcctgagcgcctggttcgacccggacggcaccctggtggtgggcggcccggactacagccagccggccggcgcgcggctgatcctgcgccgcgacggccagggcaacaatctgctcagcctggccgaaacccgctcgcacgcgcagcgctactccgaattgacgctgctgggccagggccacggccaggcgctgacgccgggccgccacgcgatgaagcaccacagcttcgattccgacgtctgctaccacaagccgcgcatccaggtggagccggacgccgccagcccggcggagctggcggcgcgcgccgacaagatgctggccgactcccgcctggccggctacaccctgtccgccaccgtggccggccaccgcgacagccgcggcatgctgtggacgccggggcagcgcatcgaggtggaaagcgagccgcacggcatcaacggcgtctatttcctgatggcgcgcaccttcgaaggcggccgcggccagggcagcgtcacccggctgacgctgaaagaagacaaatgctggattccggtgatgcgcgccggcaaacaatgacaggagacaccccatgtggcatgaagtagaccaccgcatccgccgcgccttcagcaatgtgcgccagggcttccgcgccgcgctcacccacgtggacagcgcgggcgcggtgcagaccgcccaggccgaaggcctggccggcgaacagctgcaggacgccgagctgttccagcactacggctacacctccaacccgccgccgggtagcatggcgatggtgctgccgctgggtggccgcaccagccacagcgtggtgctggccaccgagcacggcagctaccggctgcaatcgctgcagccgggagaagtggcgctgtatagcgacgaaggcagcaagatcgtgctcaaacgcggcaagatcatcgaggccacctgcgaccacttcgtgctgaactgccaaaccatgcaggtcaaggccagcgacagcatcgccctccaatgccaaaccatgcaggtgaacgccgaccagcaggccgccttcgccacgcccacgctgcaaaccagccagcagctggtcgcccagggccagatcagcggcaacggcggcctggcggtgcagggcggcggcggcgccagcttcagcggcgacatcaaactgtccggcgcgatgaacgccagcggcgacgtgaacgccggcggcaagagcctggtttcccacatccacgacgcgccgaacggccccaccagcccgcccaagtaaacggcgccgcgactgaccggcgtccgctgcccacccctccccgtttccaggaaaatagccatggacccactgctggaccccgccaccggcgactacgccggcacttccaccgataccctcgccaacgccgtctacctgcgcctgatgacccctctgggcggctggtgggccgacccgacgctgggctcgcgcctgcatgagctgtcccgcgccaaggacagcggccgcgtcgacctcctggcctgccaatacgccgaacaggcgctgcaacccttgcgccaggacggccgcgccagccggatcgaggtgtcctccagccggcaaggcccgggccggcttctactccagatccgcgtcgccgaggccggcggccgcacccgacatttccaacatcaagtgaggatagcctgatgcccctgcccactcccgacttcgccagcatccgcgacacgctgctgcgcgacctgcaaaacctgcgcgccgacgccgacaccgggccggacagcgatttcttcgtccgcgccagctcggtggccagcgcggccgaaggcctgtaccagcaccaaagctggatcgctcgccagatcttccccgacaccgccgacagcgaatacctcgagcagcacgcccgcctgcgcggcatcgtgcgcaaaccagccagcgcggccgccggcaagctgcagctgagcggcaaccccaacaccatggtcaacggcagcctgcaagtgcggctgggcgaccagctgtacgccacgccggccaccggcggcgacggcggcccctacgcctttcagctggacgccaatggccaggccacggtcgacatccgcgccagccagcccggcccggccggcaaccagcccgccaatctgcaggtggacctgatgcaggcgccgcccggcgtcgccggcaaggcgctgctgctcagcatgggcggcgcggtggatgtggaaagcgaccaggccttgctggagcggctgctggaattgatacgccggccgcccgccggcggcaaccagcacgactaccggcgctgggcgctggaagtgaagggcgtcaccgccgcctacgtctacccgctgcggcgcggcctgggcaccgtcgacgtagtggtcaccgccaacaacgacctgccgtcggccgacaccctggccgcggtgcaagcccatatcgaagacctgcggccggtcaccgccaagagctgcctggtgctggcgccgaccccgcgcgcggtcgacatcgacctcgcgctcaatctgggcggcatcagcccggacgtcttcacgccgcagctgcagcaaacgctgcaagcctacttcgccggcctcgctccgggcgagcgcctggtcaaaagccggatcgaggcgctgatctccgatctgcccggcgtgcaagaccgccagctcaacgcccccgccggcaatgtcgcgccggtttccgacgccggcaaggtggaatggctgcggctgggcaaattgacgctgagggcgatgccatgatgccgcagcccccctaccaggaactgctggcccggctgctgccgccggccagctacagccccgacggtccgcggctgcaggccgaactggccagcgagggcgcggcgctggaccgggcgcagaacagcgcccgccagctggccggcgccgtcaccccgctggcggccgaaacgctgctgccggactgggagcgggtatgcgggctgacgccgcccgccgacgcgccctaccagcagcgccagcaggcggtgctggccaagctggcggaaaccggcggcctgtccatctcttacttcacccggctggccgccggcatgggctaccggattaggatcgacgagccgcagccgttccgcgccggcgtcaaccgcgccggccagcccttgtggagcgccgacattccctgggtgtggcaggtgaccgtgtacggcagcaaggtccgcccctaccagttccgcgccggacaatcgctggccggcgagcgcctcaccactttcggcgaccccaggctggaagagctgttcaacgacctcaagcccgcccacaccttcgtctacttcgcctaccagccgtaaacctctcccgacgctcgtcccgcgcgcgtttcccccccctcgcgccgctgcttccggcggcagcccatcttccctcatccaggagcgcttcatgcaagatccgatcaagcctgtcccctcgccagaccagaaattccacgatggcaatcccgccaccggcgaactgggcaccatcgtctcggccgactggctcaacaccctgcaatccgccacccaatccacccagcaggaactggtgaccgtcatccagaacagcggccagaaaaccgaccccgcgcgccaagaccagttgctgcaagcgatgcagaacctcgcctggggcggcgcgcagcggccatccacgctggccggctatggcatcgccatcgccagccaagcggaagcggaggccgggagcgataacagcaaggcgatgacgccgctgctcgtggggcaggcgctgaacgccgtcggcttgtccggctatgccaagccccttgccgccggctcgctgcaaacagtgcgtcccaatgggctctatcacatcgacaacaacctggtcgacggaacgccggtgaaaagcaacggcatgttgctggccaacttcctgtctccgctctggggcagccagctttactcggcctggggcggcgccacctatgaacaaagactggaaaacggcaattggcagccctggatccggctgctgaaatccggccaacagagcacgatggcagattacggcatcgtcgatggcgcgaccttggcacaactgaaggcggcaacggcgtttgccggcgcggtcctgcacttcgccatgcccaacgcgccagatggctggctcaaagccaatggcgcagcagtcagccgcagccaatacgccgcgctattcgcggccatcggctccacttacggcgccggcgatggctccactaccttcaatctgccggatctgcgcggcgaattcattcggggatgggacgatatcggcaaaacagatcctgatagccccaaacgcaaagtcggcgatcgacaagcacaacaaaccgcgactcataaacacgtgattccctggggagagaacattgccgtcaacgccaccgccttcggcggcaccaacaacgtcggccgaatgggctctgttgcaaatgactacgacaaccgctggtattactcgaatgacggcagcgactttgacggcgtgctcaaccccccagacaccatcggctcggaaacccgcccccgcaacatcgctttgctcgcctgcatcaagtactgaggaatcacgccatggataaacaaaaaaccgtctatagctaccatccagagacctacgaatatctcggcccaagccaggcagatttgtcgccgctggacccgggagaagtctggctgctccctgcctgctccactgaggccgaaccgccgccagccgacgagcatcaggtccccgtattccggaacggcgactggaccttgcagcccgactggcgcgccgtcccgttgtggcgcaagcaaaccgctcaagcgatacaggcgcagataggcgacaccccggacagcctgcaagccaccgccttgtcgccgccgcccttcgctatctggcgtggcgatggctggagcgtggacgaggcgactcaattggccactcaaaccgtcgctgcgcaacagcaattgcaacggaagctggccgcggcctaccagagccgccgcccactggaagacgcctccgagctaggtgtggccacaacggatgagcaagcccgtctgatggattggaaacgctactgcgtggcgctctcccgcctgccgcaacaccccggctggccccggctggccgatgccgactggcccaatcaacccgcctgagtccaaacctctccacaagcaaccgcgccgattggcgcggttttctttacctagccaccgcctgtcagcactgacaggcgtccgctaagccccgtcggtcggttgcagcacaatctcctccgacccatcgacagcgacatctgtcatcggccgagcgccgattttcctttgactgttcggagacactgacatgcaagagcccatgaagctgatcaacagcgccgacggcctgttccacgacggcaacccttactccggcgaactcggcaccgtcgtcacgtccgactggctcaacggcgcccagtctgccattcaggctacccaacaagagctgctgaccgtcattaaaagcaatggccagaaaaccgacccatctcgccaggaccagctgctgcaagcgatgcagaacctcgcctggggcggcgcgcaacggcccaccacgctggccggctacggcatcgccgacgcgatgaaagccagtgactggggcgtgcagggctacaccacgctgcaggttggccccggcaaagccttcgccggcatccaggacgcctgggacagcctgatcggcaaggttttgcaggccgatgtgctgatccagatagccgacggccagtacgccacgagcggcatcacgctaacccaccaaccgttcgccagccgcatccgcatccagggcaatgtcgccaacccgtcggcatgcaagatcatcctcgtgcccgacgccaacaagctcagccatggcgtgatcttttcccgcgtacaaggcgtcaacttctccggctttcatatcgtcggcgaggccggcgccaatcactggagtcatcgctgcctgcgggtggaagaagcgtcggtggtatacgccgacgccggctccatcgtgctggagggcgccggcaacgggctggaactggatcaaaatgcgcgcggcaacttcgagcggctacgcgtcctgaactgcaagaattgtgcggttctcgtcggcggcggcgcccatgcctggctgccgtccagcacgctgatcggcctgggcagatatgccgaaactgtcgttccagccttcgtcaacgtcgatactcccaaattccggcccatgggcttggaatgccaggaaggctcgaaggcctgggctagcgacagcagcatttccaatgtcgatatcggctacatgacaacgcggaacagctatctgtggtgcgatggcacagcggtcgatcaaagcaatatcggcatgtatgcgcaatatggcggggtttgctggagctgcggcgcgcaagcccggccatcgctgcctcagggcaggcgctccaaggtgaccaactcgggaaaaggctactacgcggagtttggcggcatcatcaatgcggacatggccgtagcggaaaactgcgaacacggcttttttgccacctggaattcggtcatgacagtcagcaatggctgggcgcgcaactgcaccaaagggggctaccatgccgagatggcatcaacgatcgccgcttacaatacagatacgacagggactgccacggcgtacgatcccaatcagaacttcagtaattggaacggcatcgtcgtaacaaaaatttgagcacctatcccacccttcctgactgacaacccgtccactgcccgctggacggggagtcccgcacaatcaacgacatcagtcatcggcccccgctgccgactcttctcatcaaacggaaggcgctttccatgcaagatccattcaaacccatccacagcgccgacggcctgttccacgacggcaacccgaccaccggagaactcggcactgtggtcgccgctgactggctcaatggcatgcagtccgccatgcaggccacccagcaggaattgctgactgtcatccagagcaatggccagaagaccgaccccgcgcgccaggaccagctgctgcaagcggtacaaagcatcgcctggggcggcgcgcaacggcccaccacgctggccggctacggcatcgccgacggcgccagcaaaaccgatctgaagtccgccatcgacggcgtggtggccggcgcgcccggcgcgctcaataccctgcaggagctggcggcggcattgggcaacgatcagaacttcgccgccagcatcgccaagctgctggccggcaaggcggacaaggccaccacgctggctggctacgggattgctgacggcgcaacctcgactcaggtcaacgccgccgcgccagccggcatggtggcctatttcgcgatgaaagacgcacccgccggctggctgatcgccgacgggcgggcagtttcgcgcaaggactacccggcgctgttcgccgccattggcggcctttatggaaatggcgatggctcgacgacattcgcattgcccaacctatgcggcgaattcatccggggctgggacaatggccgtggggtagataccaatagaaattttggcacatcacaaaccgagggcattagagatcacaaacacgcaggtcttatcaatagtccatacggagataattggaactatatttacggctacaaaaataacggcccaaccgcaccatcgggtggggttggcgcatttcctggtaatcaaactctacctcaaatcacgcctgtttctcatgatggcaatccgaataacgccattcaaacttatataactttgaacgcagcaagcgaaacccgcccccgcaacgtcgccctactcgcctgcatcaagtgctgaggcggacatccgcgatgttccacgtgaaaccgcgcctgccggcgcggtttttcatcgttcaacgcagcaccaccagcgcggtgccggcgcagctgaccgccgcgcccagccaggccagcggcggcggcggccgtttcagcgccacccacagcatcggcaggatcaacaccgggctcagcgccgacaagatccccacggtggcgacatcggcgcgctgcaaggccagcatgatcagcgtcatgcccaggcccagcgccaccaggccgttcagcgcggtctggcccagcatgcgcggcgtgtacggcccgcggctcttcgccagtttccagccgctgagccacagcagatagtgcgcgccgcagctgacgcccatccgcagcgccgacgcggtcaccggctccaggccggccgccatcgccggcttggcgaagaaggtgcccagcgcctggcatagcgcggcggccagtcccaaggcgacgccggcggccagcttgtcgttgcgctcccaggcatgggcgtccacctcgcggcggccgaaggccaccgccagcagcaccccgccaaataccagcacgctgcccagcagcgcgcccgcgctcaagcgctctgacagaaacaacacgcccagcaacaccgaaaacaccgaatgggtggcgaacaacaagccggtgcggcgcgggcccaggcggttcatcgaggcgaacatcaccgtgtcgcccagaaagatgccagtcaacccggacaacagcgccggccacaggctggcggcgctgagcgtgtaccagccgccggacagcaggctgtagccgccgagcaaaaccgtcagcagcgtcaagcgcagccgggtgaaggcgaaggggccgaaatggcgggacggcgtggcgccgagcatggcgcccagcgcccagcagccggcggcgccgaccgcggcaaggtcatacagcatcattagtccagtaaatagatttccacccgctccttgcccttgccgacgttgcggcgcttgagcgcgatccgccccacctcgccgctgcgtttgaggtgggtgccgccgcaaggcacgcgggcgaagccgggcagctcccagtagcggcgcccggccgcttcgtcggaaaaagcgctgttgatgggcaaatcgtcgtcgatcaacgcttgcgcggcggcagcgatgcccgccagccaaggcgtgatgggctgatccagcgcgaaatctatccgcgccttgtccgcggcgatgtgcgcacctatcttcgccacgcccgccaccgcgcggcaaatcacttccaataccagctcggcggcgaaatgcagccgcatcagccggtagcggcgcggccagtctatcgccaccgccaccgcgtcgccggcttgcaaaccgtggccggcgtccagcgtgtaggcgatgtccgcgccctgcttttccgccagccgcaccggatggccgcctatgctgccgctgtcgctctcctggccaccggagaaagcgtagaaaatggtttcttccagccagacccgcgcgccgtcgacgcggctgacgcgggtggcgagttcggcctggtagggatcactccagaactgcttgcgcgtcaccgcccgccgccttcctcaggtatacgtcctggtccagcttctccatcagccgttccggccgcgacaacgcggcaaagccgtattgcgcgtacaggccatgcgcgtcggcggtggccagcatcatgcggcgcaggccttgcagatcgggatgcgccagcgccgcgcccaccagttgcttgcccacgccccggccccgccaggcgtccagcacgaacacatcggccagataggcgaaggtggcgcggtcggtcaccacccgggcgaaaccgatctgcgcgccgtcggcggcgtaaacgccgaagcacagcgagtgcgccagcgagcgctcgagcacctcgcgcggcaggcttcgcgcccaatacgactcctgcgccagatagcggtggatcatgtcgcgatccagccgctccggacaggtatccacttcccacgccatcgcgttgctcccggtcggaaaaatcacagcctaaacaatcgcatgggccgaaacaagcatttggcatgcaaacaagtcacaactgccagacggccaatgttttatggcatttcattgccgaattgtttgcaactagccgttgccagccagagtaaaaactcgcaggatatcggtttgccattccgccgccgccgccatgaagccactgaccctgctgagaaacctgctgttcgcgctgctgctgctggcgatcgcgctgtggtgctacggcagctggcgccagcagccgcaactggtcgacgccgccctgtatctgggcgacgcgctggtgatgagcggcgcctacctgttgcccgccatcaccgccgcgctggtgaaaagcccgcgcctgaagaaggtggcgctgatcaatgtgctgggcggctggctgattctgccatggatcatcgcgatgggcctggcgctgaaacgcgacgacctggcctgagcgccgcgccgcatccgcggcgacccgccacacgatagcgcgggcgccgccaaccaagaggagaagactcgtgttccaacatgtagacgcctacgccggcgaccccatcctgtcgctggtggaagccttcggcaaagacccgcgccaacagaaggtcaacctcagcatcggcttgtattacgacgaagccggccgcatcccgcgcctgaaggcggtggaacaagccgaggcgctgttggccagccagccgcaaccgccatgcacctatctgccgatggacggcctggccccctaccgcgccgccatccagaccctgctgttcggcgccgagcatccggcggtgcagagcggccgcatcgccacgctgcagacgctgggcggctccggcgcgctgaaagtgggcgccgacttcctcaagcgctacttcccggcgtcccatgtctgggtcagcgacccgacctgggacaaccacgtcgccatcttcgaaggcgccggcttcacggtggaacgctatccctacttcgacccggccacccgcggcgtggacttcccggccatgctggccaagctgcagacgctgccggccaagagcgtcgtgctgctgcacccgtgttgccacaatcccaccggcgccgacctcagcgacgcgcagtgggaccaggtggtggccgtggccaaggaacgccagttgattccgttcctggacatcgcctaccagggcttcggcgccgatctggagcaagacgcctacgccatccgcgcgatggcggacgccggcgtggcctgcctggtcagcaactccttctccaagatcttctcgctgtatggcgaacgctgcggcggcctgtcggtggtgtgcgacgacgccgccgaggcggcgctggtggccggccagttgaaggccaccgtgcgccgcaactactccagcccgccgacgcacggcgccaaggtgatcgccgccgtgctgaattcgccggaactgaaggcgctgtgggtggcggaagtgaatgaaatgcgcgaacgcatccaggcgatgcgcggcgtattggttcaggtgctgaaggaagcgctgccgcagcgcgacttcgagtacctgaaggatcagcgcggcatgttcagctacaccggcttcagccaggcccaggtggacaagctgcgcgagcaattcggcgtctacctggtgggcagcggccgcatgtgcgtggccggcctcaacaccgccaacgcgccttacgtggccgaatccttcgccaaagtgcagtaaagcctcgacaacgggccgcggctttcggcggcggcccgcctcccctgccatcccccgccatgaaatgccaaagacattgacatggcgcgcgccttcttcgtatagaatatccgcgaaccccgctgcgcctggcttcccttcccggccggccgcccaattttcaggagtcaaagtatggaatctgcaataccaatgcgcgaagtcccccctggacagggctggcgctggatcgtcgacggctaccaattgtttcgccagcagaagctggcctgggtgctgatgggcatcgcctacctcgccatttcagtgctgtgctccttgtttgcgacgataggccaggccctgctcaccgtctccatgccgctgttcacttcaggctatctgctggccgccagcaagcagcaccgcggtgaaaccgtgaaagcatcggacctgtttctgggctggaaactgcgtctgcgggagatggccagctactgcctgctcatgctgcccatcgtctgcgcaagccaatacatcacccatcacatgattgaatccagcggcgcacagcatcagctgctgattctcggccaggtgctgttggtgcttttcggcatcgcctgcatgttcgtcgtcagcctgatcactttcaagcagatcaagctatggccagcgctgaagctgagcgtaagcgccgtgcaaaagaactggtgcccgttgctggtctatttcctggccatcctgctgctggccatgctcagcgtcttcacgctgggcctggcgctgctggtgctgttcccggtgatatacctgtcgcagtacatggcctggcgcgacattttctccagcgacgcgctgtaaaccgccgcgtcccagccaaaaacggcagcctcgcgctgccgtttcgcatttccgacccaggctacaccggcgtggcggcccgccagcccaagccaggccgcgtcgccttccagccccgccaggcgcaagctgctgagcgccagcttgacgccatgcgggtccgacaagtccagcgccaggcggcggatggccgcggcgtcgcgtcgcgtcgcgtcgcggctgcggcggccgcgccgccagcgccgggcagccgcaatagacgaataccccgatcagcgccgcctgcatctgcaacgccgtgccatcggccacctcggccagcccctgcgcgcgcgccaggctcagcgccgcctcccaggcggtgatcagatgcagggcatccagatcgcgggtggccaggaacagcagacggcaatggcggcgctgttcgcgcgcgctgcccagcaagccgggcggcaggcgggcggacagcgccggcagggccagcgcgcgttcgatgtcgtcagaaatcaggccgccctgcggcggcaacaggatgggcgaagcggtccaatcggccagcaggtcgggcagcgtctgcatcgccggcgaccgtcccggcaaatccagcagccgccagtgcgacagcgcgtatgccagcgcggcgtcgatctcctcttccaccccgctccgccacgcgtacgccagccggatcaggccatggaacgacgccccggccggcgcggccagcgccagttgcaggcggccggcccaatgccgcagccactcgccctgccgcctctcccaggccaggcgtctgcgccatgccgcctcgctggcggggtcgctcagccagccgcggctgtcggcgatatctcggccgtcgtcccgcagacgttcgagatggccatgacgcgccgccagccggcgcagacgcccctcgtccgcgcccaattccgccagcgcctgcagctccatcggcaaatggttggacaaaccgtcgcgatagctgccggaatacgccagcagcggggacaacagctcttgcatcatcacgcgtctccaatccgtcatccaggcacttcactttgctttttcgatgcagaaaatgccaattggatttcaggatcgcggcgatagcagccggcaatgccgatggaaaaagcgggaattccccctgcctgcgccgttgccgctcaggccagccagtcggccgcgatgcgcgccgccgccgctaccacctgatggcgttgcttggcgtcctccagcgcctgggtggtgaacaccgtcagcaccgccggcgcgcggccaggcggccacagcaccgcgatatcgttgctgctgccgtagcggccgttgccggtcttgtcgcccaccacccagccggccggcacgccggcgcggatcttttcggcgccggtggtgttgccgcgcagccattccaccaactgccgctgcgcatgcggcgccagcgcgtcgcccagcgccagccgccgcaaactttgcgccatcgcctgcggcgtggaggtgtcgcgcgcctcgccgggaaccgcgcggttcaactccggctcccagcgttccagcaagaagctctcgtcgccgatcgagcgcatgtaggcagtcagcgcggccgggccgcccagcaacttcagcaggaagttggcggcgctattgtcgctgtactgcaccgcggcggcgcacagctccgccaccgtcatgccgtcggccagatgcggctcggtgcgcggcgagtactccaccaaatcacgccgggcatagtggatgcgctcagcaagcaaacccggctgcttggccgaacgcgccagcaccgcgccaaccagcatcgccttgaaagtgctgcaaaacggaaagcgctcgccggcgcggtggcccagctcggccccgctggcggtatccagcgcgcacacgcccagacggccgccgaaatcggcctccagggcggccagccgcgcggcggcgctggcgcggcggtcggcgatggcgggagcggccaggctggcgaaaggcagcaaggcggcggacagcaggaacaggcggcgcggtatcggatgtgacatggtatctgccaaaaaagcggttaaacggacagcgcggcgcggcgatgagcgtcgccgcgcccggccaagcggcatagaccgccagcgcgcgccggaagttctgcggcatggcctcgccatgacgccgacacaccgccgccaggccacgcccaagatttcttcgatcaccacaccggttacaatgcgccgattccatacccgctgtcagccatgaaaccacgccaccctgtcctgttcgccggccttctcgccctttgcggattccatgccccggccatggcggacattttgcccaaaatgatcgacatccccgcgggagaatggcgcaccgacgcctgcccgggatggaaagaaggacgcgtctgcgccccggaaaaatacgcgcggcaaaccctgcagatcgcgtcgtttcaactggcggccaccgccgtcaccttcgcgcagtgggatgcctgcgtcgaggacggcggctgccaggagcctgataccggctgggcataccaaacccggccgaatcagccgccctgccaagccggcggcccgtgcaactacccctacgacgagggctggggacgcggcgatcatccggtcatccacgtcagctggaaagacgcgcaacgctacgtcgactggctcagccagaaaaccgggcagcgctatcgcctgccgacatccgaggaatgggaatacgcggcggcggcgggctcccgcgcccgcttcgcctggggcgccaagctggggaaaaaccgcgccaattgcgatggctgcggcagccgctgggatggcaaaaagaccgcgccggtcgcatcgttcgcgcccaaccgcttcggcctgtacgacatggtgggcaatgtcagcgaatgggtgtccacctgcgtgccgatccgctccaggcgaggcgaggacaaccaaacctgcatggcctacctgtatcggggcggcgcttggtcatatgacgccaaggcggtgggcgtcgacacctacaactggatagacgcggatttccgcgtcaattacataggtttccgcgtcgcgcgctgaggattcggcgcgcgccatccatgcaaaagggcaagcctcccggcctgccctcgcgattcgccatctgacggcgcgcagcccttgcgggtgacgcgcgctacgcctcacaaggacggcaacgccgcgccgtcgatcaggccgttgaaacggccgctggccaccagcgccgcggctttctcgatgtccggcgcgaaataacggtccttgtcgtagaacggcacctgctcgcgcagcatgcccttggccgcctccagcttggcgctggatttgttcggcgcgcggaagtctatgccctggcaggcggccagcagctcgacgcccaggatgccggcggtgttgccggccatgtccttcaggcggcgcccggcgaaggtagccatcgacacgtggtcttcctggttggcgctggtgggcaggctgtccaccgaggccgggtgcgccagcgatttgttttcgctggccagcgcggcggaggtcacctgggcgatcatgaagccggaattgacgccgccgttgttgaccaggaagggcggcagcttggacagattgctgtcgatcagcagcgccatccggcgttccgacagcgagccgatttcggcgatggccagcgccagattgtcggcggcgaaggccaccggctcggcgtggaagttgccgccggacaggatgtcgttgtcgtcggcgaacaccagcggattgtcggataccgagttggcttccacgcgcagcacttcggcggcgttgcggatttgggtcaggcaggcgcccatcacctgcggctggcagcgcaggctgtacgggtcctgcaccttgccgcagttttcatgcgattgctcgatctggctgtgttccagcagttcgcggtacaggcgggcggcgtcgatctggccctggtggccgcgcacttcgtggatgcgggcgtcgaacggggtgcggctgcccagtgccgcttccaccgacaggctgccggccacggtggcggacacgtacaggtcctcggcggcgaacaggccttccagcgcgaaggcggtggatgcctgggtgccgttcagcagcgccaggccttccttcggcgccagcgtgataggcgcgaggccggcggagcgcatcgccaccgagcccggcacccgcacgccgtcgacgaaggcctcgccctcgccgatcagcaccgcgctcatatgcgacagcggcgccaggtcgccggaagcgccgaccgaacccttctgcgggatcaccgggtagatctggcggttgaacagcgtcaccagcgcctcgatcacctcgcggcggatgccggagaagccgcgcgccagcgagttgatcttcagcgccatcaccaggcgcacgctgctgtcctccatcggcgcgccgatgccggcggcgtgcgacagcacgatggagcgttgcagcagctccagctcgtcggtggcgatcttggtgctggccagcaggccgaagccggtgttgatgccgtagacggtgcggccttcggacagcacgcgcgccacggtggcggcggaggcgtcgatgccggcgtggctggacggatccagccgcagttgcaagccggtttcacgtgaaacgcggcgcaggtcggccagcgtcagccggcccggtacgatgttgaggatgctcatggcttctaatctctcttgcttctttgttctattgcttgcgtatctcgttattgcggcaatgcgtacaggcggaagaacctgtcggctccccgcctcatcgcgcttacttcagcatcggcaggtccaggccctgttccttggcgcagtccaccgcgatgtcgtagccggcgtcggcatggcgcatcacgccggtgcccgggtcattgcgcagcacgcggcccagccgttcggccgcggcgtcgctgccgtcgcagacaatgaccacgccggagtgctgcgagaaacccatgcccacgccgccgccgtggtgcagcgacacccaggtggcgccgccggcggtgttgagcagcgcgttcaatagcggccagtcggacacggcgtcggagccgtccttcatggattccgtctcgcggttaggcgaggcgaccgagccggaatccagatggtcgcggccgatgacgatgggcgccttcaattcgccgttcttcaccatctcgttgaaagcctggcccaggcgggcgcggtctttcaggcccacccagcagatgcgcgccggcaggccctggaaggcgatgcgctccttggccatgtccagccagttgtgcaggtgcggatcgtccgggatcagctccttcactttctggtcggtcttgtagatgtcttccggatcgccggacagcgccacccagcggaaggggccgatgccctcgcagaacagcgggcgcacataggccgggacgaagccggggaagtcgaaggcgttgtgcacgccctcttccagcgccatctggcggatgttgttgccgtagtccagcgtggccgcgccgcgcgcttgcagcgtcagcatcgcgcgcacttgcaccgccatggatttcttggcggcggcggtgatttcggcggcggcggtcttctgcttgtcgcgccactgggccacgctccagccttgcggcaggtagccgtgcaccgggtcgtgggcggaagtctggtcggtgaccacgtccggggtgatgccgcgcgccaccagttcggcgaacacgtcggcggcgttgccgagcaagcccaccgatacggctttgccgctttgcttggcgtcctcgacgatggccagcgcctcgtccaaggtggtggccttgcggtccacgtaacgggttttcagccggaaatcgatgcgggtttcgtcgcattcgacggcgatcatgctgaaacctgccatggtggcggccagcggctgcgcgccgcccatgccgcccaagccgccggtcagaatccagcggccctgcggcttgccgccgaagtgctggttggcgacggcgaagaaggtttcgtaggttccttgcacgatgccttgcgagccgatgtagatccacgagccggccgtcatctggccgtacatcatcaggcccttcttatccagctcgttgaagtgctcccagttggcccagtgcggcaccaggttggagttggcgatcagcacgcgcggcgcgttttcgtgggtcttgaacacccccaccggcttgccggactgcaccagcagcgtttcgtcgtcttccagccgccgcagcgtctccaggatcttgtcgtagcattcccagttgcgggcggcgcggccgatgccgccgtacaccaccagggattgcgggtgctcggccacttcggcgtccagattgttctggatcatccggtaggcggcttcggtcagccagcttttacacgtcagctggttgccgcgcggcgcgcggatcacgcgcgacgggtcgtggcgggggtcggtcatctctgtctctcctcaggtgatgcgcaatcaacggcgtaaatgacgggtcaagctccatgccagccgcgccgccgctttcgcgccatggctgtcgatgtcgtattcgggattgaattccaccaggtcggcgccgatcagcttgccgctcttggccagccggccgaccagcgtctccaccaccgcgatgtcgacgccgtagccggccggcgccgacaccgccggcatctgcgccgccggcagcacgtccaggtctatggtcaggtagacggcgtcgacgctgtcgaggaattcggccaactggccgcggatgtcggccagctgccagccggtcatctcggtgtccagccgccactcggcgcccagcgcgcgcgcggtgtcgaacagcgcctgggtgttggcggtttcggccacgcccaggcacaggtagcggaaatgctggccgcggcgcgcgcagtcggcggcgatctgcgcgaacggcgtgccgctggtggcctcgtcggcatggcgcaggtcgaagtgggcgtcgaaattgacgatgccgatgcgcttgccgggatgggcgtcggccagccccagccagtggccgtaggcggtttcatggccgccgcccagcaccagcggcagatggccggcttccgccgcctgctgcaccttcaacgccagtttgcgctgcgcggcgtccagattgccggcgtcgcacaccacatcgccggcgtcgtacaagggcagggtcggatggtaggccaggttggccagcgccttgcgcagcgcgcgcggcccgttcgccgccccgacgcggccctggttgcggcgcacgccttcgtcgcaggcgaagccgatgatggcgacgccgggcgccgcgccttcggccagcggctgcaccagctggtgccagcgccgcgcgccgtcgccctcgcccttgtcgatgcggccggtccagccgctcatgtctatgctcatgctcgctcccgcttcattcgaggttttgcgccgcgccgcggaacacccgctgcttcagttgcggcgcgccgacgctgtaggccagctcggccggatgatcgatatcccacaccagcaggtccgccacatagccggccgccagccggccatggctggcgccgcgtcccagcgcctgcgccgcgtggcgggtgacgccggccagcgcctcttccggactcaggccgaacagcacgcaggcctggttcatcgccaggcgtatcgaggcgaacgggctggtgccgggattgaggtcggtggacaccgccatcggcacgccggcctcgcgcagcagcgccaccggcggtttctgcgtctcgcgcaggaaatagaaggcgccgggcagcagcaccgccacggtgccggcgcgtttgagcgcgtccacgccggcggcgtccaagtattcgatgtggtcggccgacaggccgccgaattcggccaccagctccgcgccgtggaggttggacagctgctcgacatggcccttcaccttcaagccatgcgcgcgcgccgcctcgaacacgcggcgggtctgcgccggtgtgaagcccacgctctcgcagaacacgtccaccgcctcggccaggccggcccgcgccgccaccggcagaatggattcgaccaccaggtcgatgtagccgtcggcgtcgccggcgtactcaggcggcagcgcgtgcgcggccagcagcgtggccgccacttccaccggcagcgaatcctgcagccgcctggccgcggccagctgcttcagttcgtcggcctgggtcaggccatagccggacttgatctccaccgtggtgacgccctcggccatcagcgccttcagccgcggcaggctggccagcgccagctcctcctcgtccagccagcgggtggcgcgcacggtggagacgatgccgccgccctcggcggcgatctgctggtaaggcacgccggccagccgcttttcccactcggcggcgcggctgccgccgtacaccaggtgggtgtggcaatcgatgaagcccggcgtgatccagcggccctgcagatcgtggacgtcgccatcgaacgcggcggcgtcgacctcggcctgcggcagcagcgcttcgatgttgccgtcgcgcaacagcagcgcgtgctgctccaggcagccgtaaggcgcggcgcgcgccggatccatggtggccagcctggcgttcagccacaggctggggcgggaagcgggtgtggggctcatggcaaacctgtgcgtcggtatttgtatatacaattatccagacagcaccggctgtcaagcctgccgtgtaaaccgccgcccagtctgccgtttacaagcttttgatgttgcagggcaataaaaaggggccgcctggcaggcagcccctgttatccgggaagagcggctaattgtatataccgtttacttcttcacccgcgtctgcgagcgcaacttgtagcgcaggccggggtgagtcagccgggcaaagctcaccagcttcttgtgcgaccaggtgcggcgcagcaccagcaggcacggctcgccggcggcgatgcccagcagcgtctgctcggccacgccgggcagcaccgcttccacgctatgctcgatatcggtcagcgggcagctttgcatcaggtagtcgttgggcgtgcgcgcgcggaaatcctgcgccaggtagtccggcgcgaaagccggattgatgtagcgatcttccagctggatcgccacatcgtcctcgcaatgcactatcaaggaatggaacacccgcgcgcccgccttcacccccagccgcagcgccacttcttcgctggcgggcaaggcctccagcacgatcacctggccgctgtggcggtggccgcgggcctcgatctcggcggcgatgttgttgatgtccaagagcggcgattcggccttgcgctcggcgacgtaagtgccgtcgccggcgaagcgcagcaggatgccggcctcggccagatcgcgcaccgccttgttgaccgtcatccgcgacacgccgaactggcgcgccagctccagctccggcggaatcttgcagccgggcaggaaatggcggtcgcggatgccggacaggatatagtctttgatgcgctgataacgcggtagcggggagtctgacaccgtggttccagaattgagcgggatggccgattgtaacgcgagccgcgccctcgccgcctgatccagcgcagaaaacgccgcagcccacccctgcaggagacgtcgccatgatgacattgccgcaatggctggccgaatacgacgccagccaccgccatccgttcaatatcgccatgcacaagctgtgcgtgccgctgatcgcgctgtcgctgctcggcatgctgatcgcgctgcccggcccgctgccctgggcctggctgctatggctgggcgccgtcgcctggtactggcggctgtcgcgcccggtcgcgctggtgatggcggtgctgtgcagcctggcgctgctgctgctgaccatcgcccagagccagggcctgccgctgggctatgtgtcgctgccggtgttcgcgctggcctgggccggccagttcgccggccatgcccgcgaaggccgcaagccgtcgttcgcgcaggatctgcgctttttgctgatcggcccgctgtggacgctgcgcgcgctgtggctaaggctgggcctgttgccgcgcgattgagcggcatcgtcgccctgtcatgccgtccgcgttatcatcggcgcttccccattcgatggagcgcagcatgatctatccgcaagggctgtccctggccgaactagcgccccgcgtcggcctgatcgagctggccggcgccggcttctccgcccggctgtcactgctgggcggccagttgctggactaccgccgcgacggcgaggcgccgctgttctatctgtcgccgcaagccgtttaccagcctggcaaggcgatacgcggcggcgtgccggtgtgctggccgtggttcggcccgcacccgtccgatgccggccagggcgcgcacggcgtggcgcgccagcagctgtggacgctgcgcgaagccagccgcgacggcgaagtgttccacgtgaaactggacggcccgcgccacggcgacctgacggccagcctggcctgccgcatcggacccgacggcgtcgccatcgagctggtcagccgcaaccacggcgcgcagccgcaaaccgtcagcgccgccctgcacagctatttcgcggtgtccgacatcgacaatatcgcgctgcgcggcctggagggcgcgccggcgcacgacaaggtcagcggcgagcgcgtcgcgctgccgcaacagccgttccgcttcgccggcgaagtggacctggtggtctactccggccaggccgtcacgctagacgacagcggctggcgccgccggctgcgcatcgacagccagggctcggccacctcggtgctgtggaacccggcgccggccaaggcgcggcagctggccgacctgcccgacgaggactggcggcgcttcgtctgcgtggaaaccgccaacgccggcgaagacgcccgctcgctgctccccggcgccagccacacgctgggctgccgcctgcatttctctcgcgccgactaggcgttataatcaagggcttgccgccgcgcccaagccggcggcgcccatacccggacaacgcagcaatggcacgacccgacaagatctcccgcttcctcccgctcaccttcgccaacggcaacagcgtgcgccgtttcggcaagcactgtccgcagtgccgcgccatggtgggcgccgagcacatggaaggcatcgccagcctcaagcaaggcaagatctttctgtccgccgaagcctgctgcccgcagtgccgccagcgcttcccggtagcctgcgtcatcaccgacgacaagcgggtgcaccgcgtgctgctgcccttgtggatgttccgcatctggctcaactccgccacccgccacgatccgcagccggaaaaccaggacaactgggaaatcgaggccgaagagcccaaagggctgagcctgccggccgacgccgaggtggtgcgctccgaagaggtgctgggccgcttccagggcgagccgatctgcgcctggatcgagtaccagggccagcgcttcgttttcgaccgcgccgcgcccggcaacaacctgacgctgacgcccagcgaattgttgttcgagggccggctgatctaccgccagcagtaagcgctcacgcggctgggtccgcaagccaggccagcagttcctgcggcgacgccgacccgcgcgccgcggcggctacgcctgcaggaaatgctcaacttcatcagcgccgagctccacgccggcagcgcccccttgttccagtccgacccgccgcgcgcggcgcgcgcgatgctccaggccaagttgagccagcgcctggactggctggacagcgtattgcggctgcgcgactacctgctgggcgacgcgttctccgtggccgacgcctatctgtacacagtgctggactggctgccgcgctttgccatcgacctggccggctggccgaacttgcgcgctttccacgcgcgggtggacggccgcgacgcggtgcgccaggcgctgcgggcggaggcggattcgacgccggcgtgacggagcaaccaaaccgaatcggtcatttgtgcgcgtggcggcgcgccgcgtatgcttttcccaccgcccttgcggcgacgccccaggccggcccggccgaaaacgcacagccaaggaaaaacatgcgcaagcccttgatgaccctgctgttgtccctgccctgcgcgctggccagcctgccggccggcagcgcgcccgccgccggcctggccggcgactacggcgccagcatcggcgcccccggcaaccgcctgcagttgcggctcagctgccgcgacgacgcccactgcgagctcgccaccgccttcgaagcggccggcgcgcccagccagccggtccgccagcgcctggaccaggtgctggcgctgcaagacaagaccgaagcggagaacgcgctgcgcttcgccgtccagcaccgcggcgaccagccgctgccgccggatctcgccgaggcgatggccaagctcaaaccggttctgtccggccagccggccattcgccaatgctgggacctgaacctgccgcagcccggcgaaatgctggcctgcacgctgtccggcgccccggccggcagcgcgccgttgtatctgttcggcaccctgcaggccgacggccaggccggcttccggcgttacgtgatctatccgctgtcgcggcaatgagcatttgaacaggagacatcatgaccagaatcgccggacagctcagcccggaacagctgaaggcggcgcaggaccaggccgccgccatccccgccgccgccaagcccgccatcgccgccgggcaattcgtctacttcgccgccttcgacggcaccagcaacgacaaggacaagctgtcgcgcggcatgcaaagcaccaatgccgcccagctctaccagcaagtggcccaggcggcgaaaacccgctccgacatcggcttccattatttctccggccccggcaccgccggcaccctgcccggttcggccttcctgccgccggcggtgaccgcggaagccgcccgcaccgccaatctcgcttacgacgactttcagaaacaggcgtcgacctggctgaaaagccatcccggcggcagcgtcgcggtggccgcggccgccttcagccgcggcaacgacgccgcctcggtattcgcccagttgctgtacgagcgcggcctgaccgatcccggcagcggcaagatgctggtgccgcccggccagctgggcctggcggccgcggtgctgtacgacccggtgatgaccggcatgtccggcaatatggccttcccgcccaatagccgcaatctgctgatcctgcgcgccgaacacgaataccgcagcatgttccaggccgccgatttctccgcgcagcgcggcgcggtcaacgccagcctgcccggcaaccattgcgacgtcggcggcggctacgacaacggcctgggcgcgctggcgctgcaagccggcaccggcttcctgcaaaaggccggcctcgctatcgccgacgtgccgcagacgcgccgcttcgatccgcgccagccggcgctggtgcacgacgagggcgtcaaccagtacggccagaccatctggaccacctacggcagctacgaccaggaccgggtggcgcgccgcaccgaccaggtggcgcgccaggctgaagtcagcaccgccaacggcgtcaccaccacccgcttcaacgacttctccggcaagcgggtgcagctggagcaaagccaggggccggccggcccgcaaggcgtgatgaccatccaggactacttcaacggcagcaccagccgggtggccttcccgcccagcgcggccgccgcgcccgccgccgccctcagcccggccaagcagacgctgctgcaacaggcgcgccaggcggtggaacagctatgccagcgcgacaagctgccgttcaacgccggccagcgcgacaatatcgccgcggcgctgggccacgccgcctggcagcaagggctgggcaaggccggcttcgcgctgctgcacgacggccaaagccggatcagcctgctgcacccggacagcgctcccggcgcgcgcccggccacgctggagctggcggccgccgcgctcaagccggcggcgcaatcgctgctggcgctggcccagtcgccggacgcggcggcgcatggcgccgaagccaagccgcagattctgccgacgcgccgtcccgcggccgccggcatgacgctctgaacggggacgccgcaaataaaaacgaccgggatgccccggccgttttttcctgtgcgccgcgccggcgctcagtgcacgctggcggggtagcgttgcgccacccaggcttcaaagcgatggaacatcgcctcgtcgccgtcgccgttgtcggcgatcagctcggcgccgtgcaccaggcggatgcgggcatccagcgcgtccgggtactgccgcgggtagtcgcgcgcggcggacgcggcgatccgcgtctcggcatcggcccaggcctgctcgacgctctgggtgcaggattcggccaggtagcgggcgttgaacggctcgccggtcaggctgaccagggtggcgttgtggttgatgctgttgcccggcgcccagtagtggcgggccagctgcgggccgatggccgggttgtcggtcaggtagccgtactcgcgcaggaaatgggcgcgggtctgatacaccgccatattggccagcagatagccgtgataggcggcggccgactcctggttcagcaggtgcggaatcgccagcagcggccgcgggctgaccgcgatgccgaggatgcgctgttcggacgcgcgcgccaactccaggatgcggccggcggtcagctcgctctccggcagcgcgtaaagcgcgcgctcgaagtaagccaccaccgcgatcgagcgttcggcgaaggcggcgaacggctgcgtcgcctcgatgcgggcgcggatcagcgcgtccggaatgacttcgccccggctgtcgcgggcatagcgcttcagccagtcggcgtcgtccagcaggctgtcgcagaacatgctctgggtttcggcgtaagccatcgacgtcggcgcgaactcctgcgagaagcacggcgaattttgcgcgacgttggcgaaatgcgcggcgtggccgccctcgtggaacaaggtgttgatcgcgcgcgcgccgctgcccacctggtccggcttggcgtcggcggtgaagttgatctggccggccacccaggccgcgccgtcctggaaggcgggaatcgggccgtggcagaaaccgttctggtacttgccctcgcgctccaccaggtccagctgcatggtggcgccgcggtactggatgcccaggcggcggaaactcagcacccagcgctccaccgccttggcgaacggcaggtaggggtcgatctggcgggtgacgtcgccgctcatgtggaagcgcagattgtgcgccttcagcgcgtcgtcgccgtgcttggcctgcaattgcgccagcgcgcgctggttggcgtcgcgggtgcgggcttcgaagtcgtcgaggatggcgaacaactcgtccggcgtcatctgctcgttcttttccaccttgtatgcgaagtagtcggcgtaaccgaggctgcgcgccagcgcgttgcgctgcttgacgatgtcgatgaagccgttgtccagcgcccaacgctccaggcccagcagcgcgtcgtgcgagctcttgcgcgccgcctcgtcgcggttggtgcccatattggtcatcagcatgctgagggtggcgttttccagcgcgccgttgtcgttgacatgctgcatcttgaattcgcgccgcttggcgaacagcgccgcctccaggtcgatcagaccggtcatcagccggcgcgcctcgtcgctctcgatgatattgctctggaacagcgccagccagccgcggtagccatgcgtcagcgcccgcttctcctcgccgtccggctgggcctccagctgcgccagcgcctgctgcacggcggccaggcgcgccgggctggaaatgaagtccttgaacgcggcttcggcggcggcgaagccggcgtggtcgtcggacaccgccatataggtgtcccagaacaaatcttccttggctttgtgtatcgccaggtaatcatggttgagcgcgtcgaattcttggcgcagcgcggccagtgtggtcattgccatttctccagggggtgtcgccgctctgtcggcggcatggtttccaccggcggacaagacgccgggatgcatgagcaagtctcattccacagattggagacagtcaagacatttcaatattttgtcgcgtttttcgccgtcgggacgcatgagtaaatcaaaagcatcatcggcgctggcgatgcgtctcccagccagagcgaagccgcacgcctcaggccgccagcagcaaatccaggcggctgccgtcgcgcagcggttgcatctcgaagcccagccgcatcgccagcatcagcatcgccacattgccgggcgcgcagcgcgcgcggaaacgcgagcatgccagccgctggcggccgaaacccagcatcaggcgggccgcctcctccgcatagccttgtccccagacggtttccgccagctcgatgccgaactcggcctcgccgccgcatgcctcgcgcagcccgaccgagccgatcagctggccgtcgccgcgccgcgcgatggccagctgccaggcgcgccgcggctcgtcctgctgcgcgatgaagcgccgcagcagcatggccgaaaacgccgcagacacctcggccggcgcgtagcagcggccaaaaccgggggtgccgcgcagcgtctggtaggcaagcaagtcttcggcatggaattcgcgcagctccagacgcggcgagcgtagcggcagggtcagcataggccgcccttctccagccgcagctgttgcaggcgcgagtccagttgctggcggcgcagcgcgtcggcggcgtcctgcgccgggcagcgcggggaaatgagagtgtcggaagaaaaatgaacgcgctcgtcgccgagcacatcgcgcagcaaatggcgcgacagggtaaagatcgatgccatgacggcggtacctgtaaagagcgataaagatcaaggccgagggtggcgccagggcggcgcgcctcttccgggcatgttcccggcggccgggcagggcgcggcgggagcgcgcagtctgctaccgcggccgataaccgtcaagcatattttttatgccggtcggatgcgtccggctcagccgcggcggcggcgcgccggttgccgctgcagccgccagcgctccagactggtgcgcagcgcggcgtccatcagccccagctgcaggccgaccagcgtcgcgtacaacagcatgccctgctccgccggcatcagcggcaccgcccagccgctcagccgcggatacagcagccaggccagcaagaggcccgccagcagggtcaattcgaccgtgcgccaggactgcgcgcgcaaggccagccgcgcgccgatatcggtgaggaaaaacaccaggctgagcaggtacaaggccatggctggactccaaaagatcgtcaagaaaggaagccggctccttgcccgcctgctcctaatatctttatagccagccgccctggccgtttggccagttctggatgatgatcccgaaaaaatgacaaaaccccgccagaagcggggttgcgatcaagcaagcatcggcgtcaggcgccggccatgcgtctttcccgccacaaggcgcgcaggccgacggccgagtacagcagcagcgcggtccagatcagcgcgaagcccagcgcgcggtcgctgccgaacggctcgtcgtacagcatcacgcccagcgccagctggatgctggggccgacgtactggatcaggccgacggtggccagcttgagccggcgcgcgccggcggcgaacatcagcagcggcaccgcggtcaccacgccggcgcccatcagcagcagatcgcgccccaggcccatttggccgaaagcgccctgcccctgccagccgaaccacagcagcgccgccagcgccagcggcgacatcaggaaggtttccagcgcgagccccggcagcgacgccagcggcgccttcttgcgcagcaggccgtagacgccgaaggtggctgccagcgacagcgcgatccatggcagcgagcccgcgctgacggtcagccagatcacgcccagcgccgccagcgccaccgccaggctctgcggccggctcagccgctcgcccagaaacacccggcccagcagcacgttgaccagcggattgatgaagtagcccaggctgccttccaccacgtggccggcgttgaccgcccagatgtagatcagccagttcagcgacagcaccgtcgacgacaggccgaaaatggccaattggcgcggctggcgcaaagcggcgcgcagatcgccccattgccgcaggaaagtcagcaccacggcgacgaacaatgccgaccatacgatgcggtggcacagaatttgcaaggcaggcaccgcgtgcagcggtttccagtagagcgggaacagcccccagcagatgaaggcgcccagggtatacagcacgccgcggctggcgccggcggaagaagatgcggacatgtggtactcggcaagacggaatattccagcacacagcttaaccgctttgcccaccgacaataaccatcttcttctatacagtccgtttacaaaaatttaaccgaagcattttttgctgcactggcacataaaccgcattgccgcgacagatgccgcaatccttttgacgttgacgtaaacgtaaactatagtctggcgacattagggctaacactctaagctgcgacagccgcacacgcgccggaccctaggtataaaaataaagtgtcacacacagatggccgccatcgcagcagccgcccgacacaggatgcccacaaggccgccgtgggctgatcgccacaagcgagcacgacaggaggagaaaccatgtcaatccgccatgcagacctggaagagaaatacaccgcccccaccggccaggtactgatgactggcatccaggcgctggtgcgcctgccgatgctgcagcaagaactggaccgcgccgccggccgccacaccgccggctatgtcaccggctaccgcggatcgcccctgggcaacgtcgaccagaccatgatcaaggccaagaaacacctggacgcccacaacgtggtgttccatcccggcctcaacgaagacctggccgccaccgcggtctggggcacccagcaggtgaatattttcgaaggcgccaaatacgacggcgtctacgcgatgtggtacggcaagggcccgggcgtcgaccgctccggcgacgtgctcaagcacggcaacgtggccggcaccagcccgcacggcggggtgctcttggtgtgcggcgacgaccacgccgccaaatcgtccaccttcccgcaccagtccgaccacatcctggccgccagcatgatcccggtgctgagcccgtccggcgtgcaggaagtgctggactacggcctgcacggctgggcgatgagccgctactccggctgctgggtgtcgatcaaggcgatcaccgacaccatcgagagctcggccatcgtcgacatctcgccggaacgcttccagttcaagattccccaggatttcccgattcccgaaggcggcctcaacatccgctggccggacaccccgctggcgcaggaaaagcgcgtgctgcaccaccgcctgtacgcggcgctggcctacgcccgcgaaaacaagctcaaccacatcacgctggattcacccaaggcccggctcggcatcatcacctgcggcaagagctacctggacgtgatgcaggcgctggacgacctgggcatcagcgaggcgcaggcggccgacatcggcctgcgcatcttcaaagtgggcatggtgtggccgctggagccggaaggcgtgcgccagttcgccgaaggcctggaagagatcctggtggtggaggaaaaacgccagatcatcgaataccaattgaaggaacaactgtacaactggcgcgacgacgtgcgcccgcgggtggtgggcaagttcgccgaaaaaggcgaatgggcgctgccgcacggcgactggctgctgccggccgccggcgagctgaccccggcgatgatcgcccgcgccatcgccggccggctggcgctgatcttcgacagcccggtgatccacgaccgcctgaagttctacgacgaaaaagaggcgcagctggtgaagccgcgcgaatccatcgcccgcgtgccgcactactgctccggctgcccgcacaacaccagcaccaaggtgccggaaggcagccgcgcggtggccggcatcggctgccactacatggcgcactggatccaggccgacagcaccaagaccttcacccagatgggcggcgaaggcatcacctggctgggccaggcgccgttcacctccacccgccacatcttcaccaacctgggcgacggcacctacttccactccggcatcctggccatccgcgccgcggtggcaggcaaggtgaacatcacctacaagatcctgtacaacgacgcggtggcgatgaccggcggccagcatgtcgacggctatctggacgtgccgatgatgacccgccagctggcggccgaaggcgtggcccgcatcgtgatcaccagcgacgatccggacaagtaccagaacgcccagggcctggccgccggcatcgacgtgttccaccgccgcgagctggaccgcgtgcagcgcgagctgcgcgataccgccggcgtcaccatcctgatccacgaccagacctgcgccgcggaaaaacgccgccgccgcaagcgcaacgagtttcccgatccggccaagcgcgccttcatcaacgaacgcgtctgcgaaggctgcggcgactgcagccagaagtccggctgcctgtcggtgctgccggtggaaaccccgctgggccgcaagcgcaagatcgaccaatccagctgcaacaaggactactcctgtgtcgagggcttctgccccagcttcgtcaccgtggaaggcggcaagctgaagaaaccggccggcgccagcgccgatctcgccaaaatgccggcgctgccggaaccgaaaatcccggcgctgcatgagccgttcggcatcatggtcaccggcgtcggcggcaccggcgtggtcaccatcggccaggtgctgggcatggcggcttatctcgacaacaagggcgtgaccgtgctggacatggccggcctggcgcagaagggcggctcggtgtggtcgcacgtgcgcatcgccgacagccaggaacaactgcacgcggtgcgcatcgccgccggcgacgccaacctggtgctgggctgcgacctggtggtgaccgcggccgaagaagcgctggccaagatgcgcgaaggcttcagccacgccatcgtcaacagctacgaatcgccgaccagcgccttcctgaagaacccggacgtgcgcttcccggccaaggcgatgaaggacgccatcgtcgaatcggtaggcgccggccgcttcaatgaagtcaacgccacccgcctctccacctcgctgatgggcgacgccatcgccgccaatatgttcatgctcggctacgcctggcaaaagggcctggtgccggtatcgctggaagccatcatggaggcggtgcggctgaacggcgccgcggtgaagttcaatcaggatgccttcagctggggccgccacgccgcccacgacccggcgcgcgtcgaagcgctggtcagcccgaccgccgtggtggccttcgttccacgtgaaacgcctgacgccgtggtccaccaccgcgccaccctgctcgccgcctatcagaacgagtcgctggcggagcgctacaaggcgctggtgcagaaaacccggcaggccgaagaggcgctgaatccggccagcggcgcgctgacgctggcggtggcgcgcgcctatcaccatctgctggcctacaaggacgagtacgaagtggcgcggctgtacagcgacggcgaattccagcgcgagctggccagccagttcgacggcgactacaagctgcgcttccatatcggcgtggcctggctgacccgcggccagccgcgcaagatcgccatcggcccgtggctgatgccggcgatgaaactgctggccaagctgcgcttcctgcgcggcagcgcgctggacccgttcgcctggcaagaggaccgcaagctggagcgccggatgataggcgaattcgaacagcagctggccggcatcctggcggcgctgacgctggacacgctgccgcaggcggtcgaagcggtgaagagctgggaaggcgtgcgcggcttcggccacatcaagctgaaaaactaccagcaggcccgcagcaggcagcagcagctgctaagcggcggcgcggcggctggcaaggcgtcgcgcaacgtggcctgatcctgattgtttccgcagctttgggcgtcgacctcggtcgacgcccttttttctggccgcgctgaaaatgccgtatggattgactatcctgttattcatgccgatgcgttcaccccaactggagactgccccatgcccgccctgctgcgccgtaccctgctcgcctcgctcagcctgatcctggtcgcctgcgccacccaacccagcaagatcgcccaaaccgccggcggctgcgtcggccaggtgatgccgccgccggccggcatgagcgccgcgcaaaacagcgcgctgctggccaaggccgtcgccgcgcccggcaacggcggcctgtgcgaaggcgcggtctatcagcaggacgccgccgcgcccggcgtgacggtttaccgcgtctgggacagcgccaaacccaactcgcggctgggccgctggtggtcgttcagccagccgcaaggtccggtggccaaataccaggccgacaacgccatctgtccgtcctggagccagctcaacagcgtggtgcgctgccagctgaaggccggcgtgcaagtggcggtgggcaccggccagagcgccaattgcgcgcccgaccccgacttcccgccgtcgccggtcaaccagatttatgtgcccaacaccagcccggacgacatccaggtggaaaactgccaggacgaaggagccttcccgccggcgatgtgagccgggctgggccgcgcgctcagttgccgcccggcggcgcggcggcgaaccagccggcgatgaaatcgatcaacgccctcaccttggccggctgcggcgttttcttcggatatgccaggtagaccgggtggctgggcgtttcccaatcggccagcacccgctccagcctgccgctggccagcgcggccgtggcggcgaaatccggcagccgggcgaaaccggcgccggcctcggccagccgctcgttcaggctgtagtcgctggcctgcagccagtgcgacacctccacctcctccaccctgccctcccgctcgaacagccaacgcgcgccttgctggtagcgcgggtgcaccacgcagggctgccgcgccaggtcggccggccgccgcggcgcgcccagctcggccagcagcgccggcgccgccaccacccagtcgcgagtgaagaacaggcagcgcgccaccagctgcggcggcaacgccggcgccgagcggatggcgaggtcgaagccgtcctcctccaggtcgcgctcggccagactgacgtccagctccaccgtgatctgcggatattgtcgatggaacgacaacaataaatcggcgatgaaagcgccggcgaacatctgcggcaccgtcagccgcacccggccgcgcggcgcgtcgcccagttcgcgcaccgccgccgccgattcgcgcagcaaatcgcgcagccggcggcaatagtccaggtaagcatggccggcctcggtcagcaccaggcgccgggtgctgcggaacagcagctgcgcgcccagctgcgcctctagccggttcaactgcttgctgacctgcgatttggaggtgctcagccgctcggccgcggcggtgatgctgccggcttccgccaccgtcagaaaagtgagcgccagcggcgaggttggctcgattgtttccatattgattccaatatatccgcgtttgcccggtttttccaagcgatgggcgcgcctaagctgagccttccccaacacagaacgcaaggagaacgaaatgaaaatcctgctgataggcggcagcggcaatatcggccgcgccatccgcgccgagctgtccggccgccacgaaatcatcgtcgccggccgcagccacggcgacgtgcgggtggatatcgaggacgagcgcagcatcgtcgaaatgtacagccggctgccgcggctggacgcggtggcggtagccaccggcggccgcaacggccatgtcgccccgctggccgaaatgagcgccgagcgctaccgcgtcggcctggagtccaagctgcttggccaggtcaacaccgtgctgcacggcgtcggccagctggccgacggcggctcgttcacgctggtgggcggcgcctggcagccgcaggccatcgtgcccaagatcagcaacgtctacatggccaacgccgcgctggaagctttcgtcaacgccgccgcggtggagctgccgcgcgggctgcgcatcaatctggtcagtccgctattgctgaccgagtcggaagccgaatacggcccgctgttccgcggcgtgccgctggtggacgcgcgcagcgtggcgcgcgcctacagcctgagcgtggaaggcgcgcagaccggccagacctaccggctgggccggctggactgagcctgcccgttcacggctgccccagccatggctgtcccaccgcctccagcctggcctggaaggcggccggcggctcccagccgtggcgctgcgcatgcggcgccaccagctctatcgtcagctgtttggcgtgttcgcggaacagcgcctgctggccgggatggcgcacccgctggctgaattgcttttgcaccggactgagcaggctggtgacgaaagggctggcgccgtcgccggccggaatgaaggcgccgtggaattcccgcccaggcaggccggcatcgcgcgcgatctcgcccagcgcgcgcaggtagccttccggcatcacgccgccattggcgcggtggaaggcgtttttcgcctcgctgtacatcaccgcgtaagtcgactccagcgcctggcggcagaacaccgcgtcgccggccagcgccttgcccagctcgtcggcctgccggcgcatcaccgccttgacgtcgccggggctaatcggcgcgcgcgacaggccgccgcgcgtcaatccgctctgcctgggcgcggcgcgcccgccttgaaaacacgcggcgaaacgttgccaaccgccgctgcgcgccgctgccggccgttccgccgagaacggcttgtccgcattgcccgcgccgcgcagcctggcggccagaccgcggccggcggccgccgcgcgctctcccgccccggccagccagctgcgcgcggcggcgcccaacatgcctatcttcatcctgttctccccctgtgcgcgccgcgccggatgcgcggcggccgcagtcgccattgaaaggcaggccgcggccgccggcttgtaaaaatggctcacgccttcgggagaagccctgcgcttacccctgccgcaccaccatcgcctgctccggcgccgggaagccggccgccgccagcaccggccccagcgcgctgaattccaacaggcggatcgcttcggcgtggccggcgcggctggccagctgcgccttcaggtccacccgccgcgccgggttggcgctgaagttctggatagtgtcggagaagatcttgttgttgccggccagagtctgcgcgccgtccggcgtgtccagcgtggcggcgacgatgttgccggcgaaattcgccgccaggtccagccagtgattccaattgatgttttgcatctgacagccccttgtctgaaaagccggataacggctttctcaagataggcggcggccatggccatgccaaatggatcagcagcgcagctggcggcaggtgtcgccgatgccggcgtggacgcagaggtcgaacagggcgtcgaaacgagtgggggtgtagttgatcagcgcgcagggaatgccggcgcgcgcggcttccaccggaatcagattgaccggcgacacctccagcgatgagcccatcaccagcagcaggtcagcgttcagcgccgcctggaacgccacgtcgatcaagggcaccgcctcgccgtacagcaccacgtccggcttgagcaccgtgctgcagcggcggcagaccggcacctcgtgccgctgcacatagtccagaggatgcggcgtgcggcagtccggacagctggcggtaagcagggtgccgtgcatttccagcacccggctgttgccggcgcggccatgcaggccgtctatgttctgggtgaggatggtgacttccttgcccgacgcttccagcgcggcgaggaacaggtggccgtcgttgggctggtagtcgcccaccaacttgatgcggaagatgtcgcggaatgcctgccagaaagccgtcggcgcgcggcggaagtagtcgaccgacaccgcctcggccaagctcatgtcccgcgaccacacgccgttggcggaacggaaatcggggatgccggattcggtgctcatgccggcgccggtcaacaccgcgatgcggcgggcgtcgtcgagcaattgctgcagatacggcaactgccgctggggggaaacgctcatcaagacttccttaccgccggacttgcttcgatccactatagcgcaacggtcacagcggcgggtatttgatggcgttcttggccattttgtcgcgtaccgccgcgtccagatcgacgccggtcaccatcgccaaccgggtcagatacagcagcacgtcggcgatttcctcctgcagatgggtgaagcgcgccggatcgtcgcgcagccgcgcggcggcgtcgtcgtccagccactggaagatctcggccagttcgcccacctcgcccatcagcgccagcaccaggctgcgcggcgagtggaaacggttccagtcgcgctcgtcggaaaagcgctgcagcgcggcggcaagtcggctggcatccagcaaggtgggctgcgtcattcgggtaatcctgtttcacgtggaacggcaaaagcctgacggcacggcatcttaagcgtagccggcccgcggcgccagcgcggccggccggcgcggcgggaaatgacaatgcccggcggcgccgggcatcgggagacggggcactgcggcgggtttactggcccagcccttccgccttcaaggcctgctgggtcgccggcaaggccgccacccgcttcaggtagtcgagcagcgccgggaaatcggccagcgagcgctgcacgtactgcgcccaagacaagcaggtgaataagtaagcgtcggccacgctgaactggccgccttgcagatacggcgttttttccagctgctgctgcagcagcgccagccgcggctgcagccgcgcccaggcgtcgtctttcacttcttcggtcttgccgaagaagatcggcgaaaaattcttgtgcacttcggtggagatgaagttcagccattcctgcagccggtagcgcgccagcgtgccgttggccggcgccagctgcttgtccggcgcctggtcggcgatgtactgcaggatggccacgccttcggtcagcagttcgccgttgtccagctgcagcgccggcacatagcctttgggattgatggtggagaaatccgcgccgccggcggtgagatgcggctgcgcgcgcagatccaccttttcgctgccgaaagccaggccgctggcgaacagggcgatatgcgaagccagcgagcaggcgccgggggaaaagtacagtttcatcacaactctcctgtgcattaaggaagggacaaaccgcaatcggctgtcagcctgagccaaaatcatgccaattgcaaccccccggccggcagggtcgcgccgctcatcccagcagcgaaaccagccattcgatgcgcaggttccagccggcgaaaccggccagccagaacagcacgcccagcgcgccgaacgcccaggcgctgaacagcggcaacaggttggccgacaaggccgccaccgccgcgctggccaccgcgatcgacagcgcggcatcgctgatgtcgaacaggtcgtggcgctggttcagcgcctcgaaacccttttccagcccttcggccttgcgctgcagcgcctcgccttccgccttgtagcgctggatctcgtcctgcagctcgcgctgctgcggcttgagcgccgccgcgctggcgggattggccagctccagcatcttggcctggcgcaggctggcttccgtcagatgcagcttgatctttttggactggtattccgaccagctgtccagcgcgtcggtcttcagcaactggcgcgcctggacgatattgtcgtccttcagcttgcccagccccatcaccaccgacaacagcaccacggtaagcgccaccaggctgttcaggcgcttcttctccgcctccacgctgatttccacttccatcgaccctctccttgcgttcgctcggcgccggaaatccggcactcacccagcataacgcagcggacggcgaaaggtggccctaaccggccttcttgccgaacaagcgcgggcggctatccgccggcgcggcggagcgggttttgaactggacgtacagggcctccacctcggcgcgcgcccagggcgtgcgccgcaggaaggtgaggctggacttgatgctggggtccagctggaagcagcggatattgaccctttggcccagcccgtcccagccgtaatgggcctgcagctcgatcagcattgtctccagcgtgacgccatgagtcgggttgttggactgcgctgcgttcatcctatcggtcctgccatgtgaaagccgcgagtgtaaggccgcgcccgcgcgctggcaaagctagttggcgccgccggccttgcggcgggcgcgcttggcgggagccttggccggcgcggcgtccggcgccgggtacagctcgccggggtctgccgtccgggtgccgccgccgtccacccccatcgccagcgccacccggcccagccgctgctgcttttccacgctgatcggcccggcggcggccagcagcagcatcaccagctccagcgccatctgccgctgctgctcgtccggcagcagatcgcctatcgtctccagcgcgcgcttctcgtcgttgcgcaccagccaggtctggcgccgcaccacctgcttgaactcctccagcgtcagctcctcgccgaggccagtgtcctgcatcacgcggcgtatcgcgttgaacggccgcacatccaccaccccggtgccgatggcgacatagatcagcagccgcagaaagccgtccaccgcgccgccctgcgagtagtactcctccagctcccgccgcttcagccgcagcatctcgccgcgctcccagccgccctgctgccggcgcacgctgtattcgcgcttgggatgcaggcccaccaacgcggcggtcagcggcgcgtcgtacaccgcgcggaaagtcatttccttcaaggcgtcgcgctggtcgcgccagccgtccagcgcgctggcggtccagctggacagggtttcctgccattgccagaacgggttgtcctcgcccagcggccgccgcgccgcgcgcaccttgtccgcccagcccggcaggctgcccaacagcggattgcggctggaaaaccagcgccgctccgcccgcgacgcgtgcgactcgcgcagccagtgcgccgattgtggcgagccgaaggcctgcagccacggcgagacgaagcagtcgtacagctgctggttgatctccgccacccgcttcaccacctggaaggcgcgctcgccgtcgcggccatcgcccagcgccaggatgtcgtccacctcgcgcggttcgaaacggatgatgtagcggccttgcaagtattgcaggccaggggtttccgggtaggtatcggtgatcaccgcctcgtaaaggccgggcggcagcacgtctatcaggtccagcgcgctggccagctcgctgtgctccttgttggcgacgccggcggaaacgaagatgcccaggtggcccacctgctcgtgcaggcagtagacgatggtctgctcgttgctgcggatgtcctcgacgttgcggtaaaggtcggcgatccagaacaatgcctgctgcggcggcgtgatgttgtcgccccaggaggcgaacacgatgatgggcgagcggatctgcctgaggtcgatgcgctgctcgccgtcttccagatagatttcgccgcggctgaggcggttgccgacgaacaggttctggctgatccactccatctcctgcttgttcagcaggtaatggccgccccaccagcgttcgaattccagaaaacgctcgcgctcgccgtcgacatgcgagtacaaatggtaggcttttttccagtaggtgttggccgggtccagctgctcgaaattgccgaccaattgcgcgccgtcgaactggccatggcccaggtcgccggccagcgaggccagccaggtgccgcccatcagtccgccttggtaacgcatcgggttcttgccggccacgccggcccagtaggacagcggcgagccggccagcagtatcggccccaccagctccggcgccgacgccgccagcatcgccagcgcccagccgccctggcagttgccgatgacgaaaggcttgccggcgcggccgcacggatgcagctcgttcactttctgcaggaacaccttttccgcccgccacacgcattctatggtctggttcggcaccggcaccgggaaaaacatcacgaaatagcacggatggccctgccgcagcgcgatgccgatctcgctgtccatcttgaagccgcctatgcccgggccgtggccggcgcgcgggtctatcaccacgaaaggccgcttgccggcgtcggcggccgggcagccgtccggcgggcggatcgccgccagcgcgtagttgaccggctgcgccagctcgcggccgtcgacgatgatgtcgaaatcgaacaccagcaccggcggatggccggaagccgcgtgctccagataggtatcgccccgctcgcgcagcacgtcgaagaacaacacgccgcgctgggcggcgtccgtccagtaatccatccagtgctgccccagcgaccaccatcccgccttgtccgcctcagccatctggctctcccccgcagtcgtcgcgctccagacttcactctagcccaggcggaacggcttcactgcggccgggaaagatatcaacagggtattgcgggttaacagtcttaaacacaagcgaattttcgcgaaaaactcgccagacaattgcatccaatactgcaagcacccaaacccgacaacggaaggaaaacatcatgaccaagctgctcaagcccctgctgctcgccggattgctgatcgccggcagcggcgcggcctacgcccaggacgccggcgccgacggcgcgcccaaaggctggcacatggatccggccaagcgcgaagccatgatggccaagcacctgcagatgctgcacgacaagctgaagatccagccgcagcaggaagccgcctggcagaccttcaccgcgtcgatgaaacacgagaagatggccaagccgcctgtcgatgacaacgccaccgcgccggaaaaaatggagcgcatgatgcagcatcgccaggcggaaatgcagaagcatctggacgcgctgaaagccttctacgcccaattgacgcccgaacagcaaaaaatcatggaccacttgcaccgtccgcacggcaagggtccccaccacggcaagcgcgcggcttccgcgcccgccaacggctgatcgacacatccatccatgcggccggcccgcggactcggaaccggcgcaagcggcagaaagaggcaatatcatgaaaggctacatccgcttgagcggcgtcatgctggctgccacgctggcagtggccgccgtggccccggccgaggcttattaccaccatggcggcccgccgcgcatcagcatcgacgtctggcgcggcggctactggaaccatggctactaccacggccgcatgggctggtggtgggtggtcggcggcgcctggtatttctacgccgcgccggtctatccctatcccagcctgtacgcgccgccggtggtggtggcacccatcgcgccacccgcgcccatggccccgcctgcgccgcccatcgccgccgcgccgccggaaccggcgcaggtctggtactactgcaaggcggtcaaacagtactatccgtatgtcagcgaatgccccggcggctggaaaaccgtcccggccaagccgcaatagcccgggagacgcgccatgaagaaacgctattacgcgctgctgctgccgccgctgctggcagcctgcaccacactgcccaccggccccaccgtcgcggtgatgccggcgccgggcaagccgtttgaagttttcgcccaggaagagcagcaatgccgcgcctacgccgcctccagcagcggcgtcagcaacaacgaggccgccaacaccagcctggccgccaatatggcgctgggcaccgtggtgggcgcggcggccggcgcgctgataggcggcaaccaccagggcgccggggtcggcgccggcgtcggcctgctggccggcaccgcggcgggcggctccaacggcgcctatgccggttacgacgcgcaaacccgctacaacatctcctaccagcagtgcatgtacgcgaagggcaaccaattgcccggccagcgcatggcgccgtcctacctgccaccgccgcgcatgtgagcgcgccatccctcccggcattgcccgccgcatccccagcggcgcggcatgccgtcggcgcatcgcgccatcttttcaaataccattaacatattgaaacaaaaagggaatttcaggccatatcattcgtcaaaacacggacgatactgcaagcatggccgcatcgcggcccactgttaaagtggcgcgccaggccatccgttcctccatcagcaaaggacttcgtcatgaccagactgtacgcgccgttgatggcctgcctgttcctcgccactggcatcgccagcgcccaggacgccaattcccgccccttcgacacctcccgggtgcaacccagcgtgccgctgtcgctgcacgacatgaccctggtggacgcgccggccgcgcaaaccccgccgccgacaaccgcccagtaaccgcctcccgcgcggcggcccgccgggcgcggtcccggtcggcccttatgccaaaactggagaacaaacgccgcacccgcgccatggttccacgtggaacgcgatggcgcggcttggagtttccacgcaggacgcccgccggctcaagggccgaaacggcaaggctgctcagcgcggcgcggcgggattgcgggtataggcgcagaagccgggcttggggccgaccttgggatggttgcggcaggtattcggccgcttttcatagatggtgcatagccgggttttggcgtccaggtacaggcaatcgccattggcgcgctgcgccagcgtgaacaggctgttcttgaaattgaagtgctggatcacccgctgcttttccagccgcttggcgatgttcttgatcggctcttccagctcgaactcgtccaccacgccgatgcggatcaggtcaggcagcctcacctcaaccggcatcgtgcaacaggacgccacgcagtcgccgcacaggccattcttgtacttgatccaggtttccaggcggttgacgtcggccacggctcatccttaaggcattgaatacgcgaaactttccccaagcggggagcgcgcattctaatggcgcggccggcggcaggcaagcgctggccgatggcgatcaacgctcaatcgccgtcgccatcgcccagcaacaccgacggatgcgccgcccggctgacgcgcggcagcacctcgggcagatagatgccctggatggcggacagcttgccgtgcgcctcccagtgcgcctggctctcccaatgctccaccaacacgaagcgcagcggatgggcctgggaatggtaggcctgccacagcaagcagcccggctcggccaggcacagcgggcgcatgcgcgccagcgcgtcggccaccagcggcacgtcctcgggcagggtgacttcaagcgtgacgatcaatggaaacatggcggtccttgcgcgcggcggcgatggcgggatatctcgattgtactcgctgggcggcggccccgccgcccagcagccgcccccagcccgttgcgagcccccttacttcaacggcggcagccacgcccgcagcttgggcggcaggcgccgcaacgcggcgctgcggcacggttgccagaatgccgacagcagcaacaagcccgacgcgatcaacagcccggccacgccgaagccggcgctctccaggccggcatgctgcaacagctggttgaacgcgtacagcacataggccagcgccgacaccatcagcgcgcggcggtctatcaccagcgacaccaggccgaacaccgcgtacaacgcgatcaccgccagcagcatcgccatgccggtgttgccattcatgatgcccaacatggaaaacagcggatgcaccagcagcggcgcggccagcaggtgcagccagaacgccacgtcggactggcgcttctgccgcgccgggtcctgccggtcccagtggacgcccagcaggaaagccagcgcgccgcccgcggccagcagcgcattggacaagcccagcgattccggcagcagcgccgcgaccgccagcgccgtcatcgccaccagcgcgcccacgcccatcgccacggtgatcggcaccttgaagcgccgccagtgcagccaggccgccagcgccgcggtcaggcctgaagccagcatagtgatcggcttgaccgcctcctcgccgcccggcagccaatccaggcacagcgccatcatgccgccgccgctgcacagcacgaagctgcccagcaacaggatgcccggcaaggccatgcgccggcgccggacgaaatactcggccagcggccaggacaccgccgccgccagccatggcgccagcagcttggacagcgagccggccacccaactcaccgacaccagcagcaacacgctggcgatcaccacgaaaatgtcgttgaagcccgacagcaggcggaaatgctcctcgtccgccatctgggtatggcgccgctgcgccgccagcgcgcggaagtcgtctatcgcctgctggctgaaaatcccggccgccgccgcggcgtccaggtcgtcattgttgtacatgccttcttgccttgaaacgatgaaaaccttgccagcataccatccgcggcgcgcctccccggctagacccccggcctcacggccggaacgcgatcaagggaatcgccatctcgtccgggtggacgccggcatgcacgccggccagccgcagcggcttctcccacggcagcgtgtcgcgaatattccagcccggcttggcgatcaacaccgcctcgccgcagcggcgcgccaggtcgggatgccgcgggccggggccgaaagcctgcgcgtcgagcaaaacctggctgggaaccgcccaacaggcatgacccagcctgcgccgcgccagttcgatgaagcgcgcggcgctgccgggccgcaggtggcaataggccagccgcgtctcgccggacaagggccgcgccagcatgccgtagagttcggcgtcggcgtccaggtccagccactgcccggccggcgcgtcgacaaaaccgtggtcggcgatcgccaccaccgcggcgtcgcgctgggcggcttcgatcagcagccgctcgaagccggcatccagctccgccagcaggatctccgcctgcggcgcggccgggccatgctcgtgcatcgccgtgtccagctgcggcaggtaaaggtaatggaaggcgggccggggcgagcgcagccgcgcggccagttgggcaaacccgtccgccgggccgcgatacggcaagcgcgcgctgccgccggcatggaagcggctgcatggcgaatcggcgatgaaatccggcagcaggcaggccgccggccgcgccaggcggtcgaatagcggcggcgcgcgatacagcgcgtcggccagcgcctgcggcgcgctggcgctgccggccggatggcgcacatacaggggcaagggcgcgatgatctcctcgccgtgcagctggtgccagcctatcagcccgtgttcagccggcgcgcagccggtcagcacggtggtgacggcggcggcggtggtcggcggaaacacgctgtcgatccgcgcccgctgccgcgcccgcagctggctgtccggccccaaccgccgcagctgggcgtctcccagcccgtctatcagcagcaggcagacatggcggtggcggccgatgccgtccagcgcgtcaacgcgcagcggcgcgtggcccaggtccgggccgcctagctcgctgctcagcgtctgcatcaggttgagcaggctgccgccttgatagtcgggccaggcggaagcgggaaaaagcgcggcgagatcgggcatggcgcggcgggcgatgagggtgatcggccattgtgtcggccgccgtcccggcaagtcaacggccagcggcgcggggaaccacggcgccggatccggctccaagatcacggtttttcatttcatcatcgcagcctatccccgccattgacgacagcgccgacgcgcggggagcggtttgccgtcgcaggaatccaagcatgaaactcgcaagcctcactctcgccctggccctgtccgggctggccgccgcggcgcaggccgatacctccaccatagtcggcggcgccttgggcggcgcggccggcgcggcggtcggagaagcggtcggcggccgcaacggcgccatcatcggcggcgcggtgggcggcggcgccggcgcggccatcggccatgattacggccgcaaggccgacgcgcccaagcgcgactaccgcaagcaccgccaccatcacgcgcgcggcaagggccgttcctgcccgccgggccaggccaagaaaggccgctgctaagcagctgccaggcgcgggcggcggtccgcttacaaaaccagcgccagccaggcccacatcgccagcagcaggatgttggacgccagaaaagccaggaagcggtgcagcgggtggttgtggccgagatggatcgccgtatggaccgcgcgcagcgcgacatagccccaggccagcgccaagggcagcggcgaggccaggttcttggcgatgacgatggcgccgaacacgtagaacagcaccggggtttcgaacaggttggagaaattgcgcgccagcttcaattcgccgtctggcggcgcgtcgccctgcatcagccggtaatagctgcccttcaccttgcccgagcgggcatgagcgagccgggtcgcccccagacggacgccgacgaaaaaggtcaacagcactaacgcgaacatcgggtagatcatcacttccccctaaggcagccattttgccgggcgccggccgcgcccgccgttcacgccagcggcgccacgccgccgttgcgcggcgtcgcgttctcgtggaacaggtcttccaggtattgcgccaatccgtcttccgtcacccagtccggaatgacgaaatcggcgggccggcgcttgccgtcgttgccgggcaggaaagcctgccagccggcgtcgcgccgctccgccaccaccatctggccgtagaccgtgaatcgatagctttgcatgcgtcggcctccgtttgcgttcaaaggctcatgattgcagaccgaccatcgtcagcgcaacgtcatgccgatggagtttcttcactttcccaacatcgccacagtcaccgggaaatagtacccatccgactgcccctctgccattcgagcagccgtcttcgaaaccttaagccacctactgtttgagcggatcgctgataactcccccgcgagttcggcggtaccttagtgtgactttggaagcgaggtttcaccgcgctgttgggacgccttttctttcgttcctttcttttggcgacgcaaaagaaaggaacacgttctcgggtggagccggcattaaaaacaaacatcctcaaagcggatctatataaaactgctaccaacgcacggtcaaaccaaagtcattaccgattctgtatcgtgataatgccgttgtctttccgcatttgctgtggagtggaatatcgtgagtctttttgacccacacaaagaaacgttatctccgcttcaccacaaccaccatgaagtgcgcactcgtatgagttctcactttgcagcaacagctgcttatcttgagaagtgcagaacctatttgcctcgttcaacgcatcaccctttgctccggatggaccagaaaaaggaaccctaacagagatactgtatgtgtcctttgcaattttcagcggccctgtatctgcacatcccgccaagattatcgatatcaaaaccacggcaacgaacttcatagacagcctccactgataagaaatttgccgcatcactccaaataaaaataggctgaaatccagcccaccgcatttagccacgttcaggtagcaataaaaaaagcaagccatgaacggcttgcctgttgtcaactgctggccaatttggtgcgtcgcccctgcggggtgacgcaccctacgaatggtgacgcgccttacggccgctgcttgaagaaggtaatcggcgcggaagccggaatctcgctcggcggcggcgttttcagaatgtgcttcttcatcttgcccatcacgtgcatttcgcaggggcggcattcgaacttcagcgtgtaggtttcgctgccggacttcagcaccatcgggtcggcgcgcacctggcccatcacccccttcacgcccttggcctgcttcggacacaggttgtaggagaagcgcaggcagtgcttggtgatcatcaggctgacttcgccctcttcctggtgcgcttcgtaggccggctctatcacttccacgccgtgcttcttgtagaagtcccaggccagcgcgttgtagacgttggcgagatagctcagctcggtctgcggaaagcggaccggcggctccaccgccgccttgcgcggctggcgcggccaggcggcgacgcgggcggcttcgagtttttccaccgcctcgcggcgcaggccgttgatgaccgaggccggcacgaaccacggctgcgacaggttcagcgccacgtcgtgcgcctggaacatggtgttgccgagcttggcggcggcgtcgcgcaggctttgctcggcgcgggcggcgtccttggccggctcaagcggcatatccacgctagcgctggcgctgcagccgtcggcgtcggtatagctcagctccagcccgccgccggcggtttcccttagcgcggcccagacgccgacgcggcgctcggccgatttcttcagcagcgccagctcccaggcgtggtcgcggttgcggctgatgtcgacgccgggcttcagcccttgcagcgccgccgggtcgttcggctcgcagcgccataccagcagtccgccttcggccttgcccacctgcttgacggtattcagctgcatgcccaccacttcgcgcttcttcatgaagttgattccgtcgccgttggacatctgctcggtggtggcgatctccagccagccgtcgccgaccttatgcaccgtgcccaagccgacgccgacgaatttgggcgaatcgaaggcgccgatgtcctgcttgcggccggtggcgaaatagtcggtggcgccgcggtggaaggtcttgtccggatccggcgtgaagtagatttcgctgctgccgctggccgccggcgccagctccggccggcgctcgaagatttcgtccagcaacagccggtagtggctggtgatgttcttgacgtaggacacgtccttgtagcggccctcgatcttcaaggagcgcacgccggcgtccagcagcgcttccagattggcgctctggttgttgtccttcatggacagcaggtgcttgtcgaaggccaccacgccgcctttttcgtcggtcagcgtgtacggcagcctacaggcctgcgagcagtcgccgcggttggcgctgcggccggtgtcggcgtggctgatgaagcactggccggagaaggccacgcacagcgcgccgtggatgaagtattcgatggtggcggaatcggccacccggtcggcgatcttcttgatctgcggaatggtcagctcgcgcgccagcaccacctgcgagaagccggcgtcggacaggaagcgcgccttgtcggcgtcgcggatgtcgcactgggtggacgcgtgcagttggataggcggcaggtccatctgcaggatgcccatgtcctgaacgatcagcgcgtccacgccagcgtcgtacagctgccagatcagcgcgcgcgcggcatccagctcggcgtcgtgcagaatggtgttgagcgtggtgaagatgcgcgcgtggtagcggtgggcgaaccgcaccaggccggcgatgtcctcgatgctgttgcaggcgttgtggcgcgcgccgaacgacggcccgccgatatacaccgcgtcggcgccgtgcaggatggcttcgcggccgatttcggcggttttggcgggtgacagcagttcgacttggtgcggcaacaggctcatggcaattccgggctggagtaagggttatcaccgcctggcgcggcgggcgcgaaagtataacggaatcatcggcttatagatagccggcgcggttgcgtaatagtcctaggtatcactacctaaaaccgcctaatccaattgattagctttatgacggctgctacccaaagaatatcgggggctgcgccccctacccctgcgagcctgtcatgttcagccaactcaccatcagccagcgcctggccatcatggtcgtcgccctgctcatcattcccattctggtcggcctgtacggcctgcgcactcaggaaggcatactcggcgacttcgccaccacctacaacgaccgcgtggtgtgcctgaagcaactgaaagtggtcggcgacggctacgcggtgggcatcgtcgacaacgcgcagaagctgcgcaaccgcagccagacgccggccagcttcttcaacaatctgcaaaaggcgcaggccgacgtgaagcggcaatggggcgactaccgcgccacctatctgacgccggaggaaaaacagctggccgaccaggccgaaacggcgatggccgccgccaaccagagcgtggacaaacttagccggatcgtgcgcggcggcgacgcggcagcgctgcaagcctatgtggaccaggaaatgtattcggcgctcgacccggtggcgcagcgcatcgccgcgctggtcgacctgcagctgcgggtggcggcggaagagttcgcccaatcccagcagcgcgccgcgttcagccatgccgccaatatcgggctgatcgtcgccggcgtggcgataggcttcctgctggcctgggtgatcgtgcgcggcctgttggccgagctgggcggcgagccgcgcgacgtggtggcgctggccgaacgcatcgccgagggcgacctggggcagaagctgcaggtccggcccggcgaccagcacagcatcgtctcctcgatgtcgcggatgcagagcgcgctgatccagctggtgcgcaatatgcagtccatcacccttcggctgtccaacagcgccaccgaactggcggcggcggcggagcaggtggccaccagcgccgaggagcagacccgcgccgcgtcgtcgatgtccgcctcggtggagcagctgtcggtcagcatctgctcggtcaacgaccataccagcgacgtcgccaaggactcggtgtccagcggccagctggcgcatagcggcgaggccatcatcggcgagacgctgagcaccatcaaccacgtggcggagcaggcgcgcgcctcgcagcagcaggccgacctgatgggcagccgctcgcaggagatcgccaacgtgatccaggtgatacgcgacgtggccgagcagaccaatctattggcgctgaacgcggcgatcgaggcggcgcgcgccggcgagcagggccgcggtttcgcggtggtggccgacgaagtgcgcaaactgtcggaacgcaccgcgcaatccaccaccgagatcagcggcagcatccgcgacatgctggactgcagccagcacgtggtggaaaacatccacaacaccgtggaccagatggaagtgggcctgagccaggccacccgcgcccgcgaggcgatcgccggcatcagcggcaatgtggagcgggtgaaacagtcgctgtccaccatctccatttccttgaacgaacagcagcaggccggcaccggcatcgccgccaatgtcgagcaggtggcgcagatgtcggaagaaaccagcgccgccgcggtgcagaccgccgaagccgccagccaggtcgagcagatggccggcgcgctgcaagttgccatcagccatttcaagctgccggccggcggccagccgtattcggccgatgcgccgctgcccgccatttccgccacggcgctgcgcgcctgagcgcgcgtctccccgccccctcgccgccggccttgccggcggcttttccttttgcgccgcggatagcaaaatattgcatcgcagcattaccactacgatcagcgatgttggtttacgaaaataaaaatggtatttgattggatcgaatttcggcagtgctcagccttgttggcgttttgcgcgcaaattcaaaattaaatttcaaatttatattcaaacttaagtaaattcatttagttgtccgctatttttataactttatttgaattttcatcccgcatggcagcattgcaacgccatgacaatcgatttcaaccagaatagtctcataccatttgaagaccactataagaccagctaacttgcctccaggacttccacgcagggattccgcaactggacctggagacaataaatgcacaagcaacgcgtcttactcttggccgtcctggccgccctttccggcctggccctggcggaagaagaaccctccgtcccgccttccagcgatggcccggcgctgaaaggcaccaagcaggccattccggcaagcgatgtctacgacctgatcaccaagtcggaaaccaccttcagcgcgctgtactacggccgcgaccgccaggaaaaacagccgaacaacagcaacggcggcgatatccgcgtcaacgcgctgaacctggggctgaacttcaagtccggctatgcctggaacgtgctgggcttcgacgccgccgcccatagttccatccgcctgaccaagggcataggtttctccgaagtgctgtaccacgactacaaggacatgagcaatccggccgaaggcggcggcggcaaggacaaaagcgacgcggtgctgagccaggcggcggtgaaattccgccagagcccggacggccagggcttttccgcccgcgccggctacaccccgatcagcatcggcaccatgggcacctccggcggcctgcagtcgcactcctaccgcggcttcgaaggcaagtacaagcttggcgacttcgaaatcggctacggctgggccgaccagttccgcaacgagtgggacaaccgcttccgcgacatgaccaattcctgggaacagggccgcagcaacggcagcgccgccaagcaggtggactacgtcaacagcctgggcctgcgttacgcgccggaaaacgccttcatcgacttcggcgtcggcgaaggcaaggactaccgccgcaccgcgcagatcgccggctcctacacctggaagctggccggcggcgacagcctgaccggcgtcgcctactacttccaaggcaaggatgaagcccagctcggcatgaagaactcccaaaccgcctggcacaccagcgccagcctggcttacaccaccggcggcctcaccgtgcaaggcggcctgggcaagagccataacccggacggcggcgaagtgaacttccgcatgacgccgtacggcaacagcgacaaccgcaacttcatccagacctggggccaggacgacgacttcgtctgggacggcacccaagtggtcaagctgggagtcaactacgacttcgccaagcaaggcctgccgggcttctcgctgggagccagcgccaactacgccaccggcctgaaaaacccgaacggcgcgccggacagcaaggcgcatgaaatcgacctcagcgccggctatacggtgcagagcggcccgctcaagggcgccagcatcggcgtttaccccgcttggtaccgctccggcgacttctacggcaagcgcgaccgcaacgacgtgaaagtgatcgcttcctacagcaaaaccttctgatccaccaagtggccggtctgccagtgccggccgcttcgcccatcgggttcgatgggcgaagccacaaaggagaaaaccagacatgaagctgaagaccctgagcctttccctgctgatcgccgccggcctgtccgcgccgctggcagcccacgccgccgacaagccggtgctggaagtgtggacgatgagcctgtcgcccaagttcgacggctatttcaaggagctggtggccaagtacaacgcccagcatccgaatgtggaagtgaagtggaccgactacccgtgggacgtgatccaggccaagttcaccgccgcagtcggcgccggcaagccgccggccctggtcaacctgaacgtgccctggacctacgactaccagcagcaaaacctgatccagccgctggacggcctgatagacaagggccagtacgtgacgggcgcgttgaaggacgtcaccttcaacggcaaggtctacgccttcccgcactacaacggcgccaacgtcatcgcctacaacgccgcgctgttcaagaaggccggcctcgaccccaacaagccgcccaaatcgttcgacgaggagctggcctacgccaaacagatcaaggccaaaaccggcgtggccggcttcgcgccgacgctgggcccgaccaagatcgaggcgctgctgatgcaaaacggcctggatgtggtcaaggacggcaagccggcgttcaacagcccggcccacgtcgccttcgtcaagaagctggccgacgcctacaaggccggcgccttgctgaaggacaatctgttcgcccaggacaatttccaggtggcgatggccgcgtacaacggcggccggctggcgatgctggaatcgacgccgaccacgctgacccgggtgcgcgacgaagcgcccaagctgtaccgcgacacccgcgtcgccccggcgccgctgggccccaccggcatcgccgccggcggctggatgttcaatttcgcggtggcgcgcaatgtggacaaggcactgctgccggaagtcggcaaattcggcaactacctgaccaacgccgacaaccagctggccttcgccaagctggccggcaccttgcccaccgcccgcaaggcggcgctggatccgcacttccagaaagtgtccggcaacgccggcgccgccgagctggcggtcggcatcgccgccgccaacctggacaagacccgcaccctgttcctgtcggtgaagaacgccgacacgctgtcggccaggctgtcggccgcggtggaaaaagcggtgaccggccgccaggacgccaagcaggcgctggacgaggccgccgcctactggagcggcaagctgtaaacgcggcacgcgcccgccgccacgcgcggcgggctgtcgtcatgcaatcagcccggtgaaaccccgatgcgcaaaccacataaaaccaccctgcagacctatctgttcctggcgccggcgctcgtgctgctggcggcgttctcgttctggccggtgggcttcggctcctttctcgccttcacccgctataacctgatcgacgcgccgcagtgggtgggctgggacaatttccgcgagctgttcggcgatgagctgttcctgtcggcgctgaagaattcggcgctgtacctgctggtggtgccggcgatccagctgttggccatcctgctggcggtgctggtcaacaacagcctgcccggcatcaagctgttccgcgccgcctactacctgccggtggtcacctcggtgtcggtgatcggcatcatctggaatttcatgtacgccgaagacggcgtgctcaacgccgcgctgcgctggctgcatctgatcaacgatccggtgggctggctcaacgatgaccatatcgcgctgttcgcggtgatgttcatcaccgtctggcgcggcataggctggtatatggtgctgtacctggccggcctgcaggcgatgccggccgacctgcacgaggccgcgcaactggacggcgccagccgttggcagcgcttctggcgcatcaccgtgccgctgctcgcgcccaccatcttgctgtgctcgatcatgtcgatgctggcggcggtgaaggcgtttgaggaagtgcagatcctgaccaagggcgggccgatgcagtccacctacaccgcgctgttttacgcttacgagttcggcatcaagtcgctgaacttcggccgcgcgctggccgccagcctggtgatgtcggcgttctgcatcgtgctggcctggctgaatttccgttacctgcaaccgcgcgaccgctgaggaggccagatgcattcttccaccaccctgcccgccgctgccgccgccatccgcgcgcggccgcggctggcgcgcctgggcaaccgcgccgtccattacctggcgctggccgccatcgggctgatcaccgtctacccgttctggtggacgctggtgaccgccttgtccggcgacggcgaagtgttcgcctttccgccgcccttgctgcccaccgcgccgacgctggccaacttccgcgaggcggtgtccagcatcgacatcctggccttctaccgcaactcgctggccatcaccgcgctgacggtggcaggcacgctcttggtcagcgcgctggccgcctacccgctggcgcgcatgcagttccccggccgccggctggtgttcggcgccatcctcgccaccctgatcctgcctagcgaggtcaatttcctggtcaacttcatcaccgtgtccaagctgcacctcaccgacagctacggcggcgtggtgctgccgacgctggccggcgcggtgggcatcttcctgatgaagcaggcgttcgaggcggtgccgcaggatctgatcgacgccgcccgcgtcgacggcgccggcgaatggcagatcttctggaaaatcatgctgccgctgtcgcggccggcgctggcggcgctgaccatcctcaccacggtgtcggcgtggaaccagtacatctggccgtccatcgtgatgtccagcccggaaaagtttccgctgtcggtcggcgtgctgtacctggccggcgccttcagcttcaagacgcgggtggtggcggccggcgcggtgctgaccgtgctgcccatcctgatcgtgttcctgttcacccagcgctacttcctgcgcggattcgatggagcggtgaaatgaccctgagcgacgaacaactggaccaactggccggccgctgtctgatggtggacgtggccgggccagccctgggcgccgaagaagcggcgcggctgaggaaaatgcgggtgcgcgccatctgcctgttccgccgcaacgtgccggacgcggcgtcgacgcgccgcctggtggcgggcctgaaagccgcgctgggcgacgacatcctggtgggcctggaccaggaaggcggcggcgtgatgcgcacgctgttcctgccgcaggcgccggcggcgatggcgctggccgccgtcggcgacgcggcgctggcgcgccaggtcggcgccgcggtggcgcgcgggctgaagagcctgggcgtcaactggaacttcgccccggtgctggatctgaacaacaacccggccaatccggtgataggcgagcgctcgttcggcgccgagccagcgcgcgccgccgccctggcccgcgcctggatggaaggccacctggccgaaggcgtggcctgctgcgtcaagcacttccccggtcacggcgacacccacaccgactcccatctggacctgccggtggtggacaagcctcaagccgagctgcgcgactacgagctggcgccgttcaaggcgctatccgcgcacgcgccggcgctgatgagcgctcacatccgcttcccggcgctggacccggaatggccggccacgctgtcgccggccatcctcaccggcctgctgcggcatgagctgggcttccagggcgtcgccatcaccgacgcgctgaacatgaaggcgatacgcgaacgctggggccaggccgccggctcggtgcagacgctgaaagccggggcggatctcgcgctggtgctgcagtttcccgatgaaatggaagccagcttcaacgcgctgcgcgccgcgctgcgcggcggcgagctggcgccggaacggatgcaagaagccgcggcgcgggtggacgcgctgacccggcgctaccccagcctcggcgatgacgactacgcggccgaacagcgcgccgccgacgaggcgctgttcgccgacgcctgggtccgcgcgctgaccgcccatggcgaggttcccctcttgcccgccggccagcggctgcggctagtggtgcaggaccaggcgccgtccgacggcgtgtccgaagccggtctgtccgccgaccggctgatcgccgcgctgtcgcgccgccacgcgctggaagtggtgcgcttcaaaaaccgggcgatgctcgactgggccacgctgccgcgcgacggcgccttcaccgtgctggcctccaccagccgcgaacgctaccgccggcgcgaacaacacagctggaagccggacttgcatctggcattatggaacccttacgccgccgccgacatcgccgcgccggccttgatcagctacggcttcgccgacgccgcgctggacgccatcagccgctgcctggccggcgagatcgacgccgccggccggctgccggtaccgctgggcggcccccaccaggagcaatgaaatgtcccgactgtcattgagcaatatccgcaaggtttacgacgacggcaacgccgtgatccacgatgtcagcctggacatccgcgacggcgaattcatggttttcgtcggcccgtccggctgcggcaaatcgacgatgatgcgcatgatcgccgggctggaggacatcagcgccggcgagctgcgcatagacggccagttggccaacgacatcgagccggccaagcgcggtgtggcgatggtgttccaaagctacgcgctgtacccgcacatgacggtgcgcggcaatatggctttcagcctgaagctggccggcaaaagcaaggccgagatcgacgccgcggtgaaccgcgccgcgcagacgctgcagatcgaacacctgctggagcgcaagcccaaggcgctgtccggcggccagcgccaacgcgtggccatcggccgcgccatcgtcaggaagcccggcgtgttcctgttcgacgagcccttgtccaatctggacgccgcgctccgggtgcagatgcgcatcgaactggcgcggctgcacaaggagctgggcagcaccatgatctacgtcacccacgaccaggtggaggcgatgacactgggccaccggatcgcggtgttcaacgccggccgcatcgaacaggtgggcacgccgctggagctgtacaaccgcccggccaaccgcttcgtcgccggcttcctcggctcgcccaagatgaacttcatcgcggcgcggccgctggacccgcgcgccgacggcgtggagctggagctgcccggcggctgccggctgacgctgcccttcgccgccgccggcggcgcggcgacgctgggcgtgcgcgccgagcacctgttcttcgccgaatccggcctgccggcgacggtgcagctggtggagcatctgggcgatcagcagatcgtctacctgcgccacgaaggcgaaggcgagcccatcgcgctgaggctgcccggccacgaggccgagccgcgcccgggcgagcgccgcttcctggcgccggacccgcgccattgccacctgttcggcggcgacggcgcggcgctgccgcggcgcgagccggcaagccagccggcggccgaactgatcgcctgacgcgagcgggcggcccgccgcccgctcttatccacaagcgcagccaaagcgcggatttatccacaacgcacagccgagaaaccaagcgccgaatccatccggatgcgcatcgcgccgggagccatcagcctgcgcgcggccagtcccgccattgccgcactgccaaggcgcttatccacagccgcgccgcgattgcacacttgtccacaatcaacggcccgcgccgccgcgcctcagcgtggaagggacaaagttgttgaaattgctaagtaaatattcgtaagacatcgagaactgccctacaactagagcaagattgttccaatacggaggttctcatgaaccgccaaacctcgctggccgggcaactggccgccatcgtcggcctggtcatcgccatcctgctgatttcctcgattttctccttaagccagctatggggcagcatccgcgtgttccgcgaccaagtggtggccgaccagcgcagcgtgcagcaagtgctgaccatgcaggtggacttcaagaaacaggtgcaggagtggaaagacacgctgctgcgcggccaggacccggccaagctggccaaatactggggcaatttccagcagcgcgagcagcaggtgcgcgacgagggcaacaggctggcggcctcggtgtccgacccgcaggcgcagcagttgctgctgcaattcgtcgccgcccaccagaaaatgggcgacgactaccgcaaggggcttgacgcctacaagcaggccggcgccgacttcaaggtgggcgacaagcaggtggccggcatggataggccgccgaccgagttgctgacccaggccagcgacctgctggccaaacgcgcgcaggccaacaccgccgccgcggaagacagcgccaacgccgccttgtggcgggtgggcatcgcgatggccgtcggcaccgtgctgggcctggccttcttcctttactacgtcagccgcaccgtgatccagcgcgcccgccagctggcggacgacctggcccggctggccggcggcgatttcacccgcccgttccacgccgggcggatggacgagatcggccgcatcgccgccagcagcgaaacggtgcgcacccatctgggttcgctgatcggcgagctgatccacgccgccaagcaggtcggcgacaccagccaggagctgggacgctcggcgcaggcgctggcgcgcggcgccgaaacgcaaaacgacgcgatcgccgacaacgccgcctcgctggagcaaatggccaccagcgtggacaccatcgccgaccaggcctcgcgcatcagcgacgattcgcgcaacagcgcgcagaaaaccaacgacggcctcgacgaggtggcgcggctgcgccgccaggcggaaaccatagacacggtgatggggcaagtagaccaggcctcgcaggccttccgcgacagcacccagtcgatcagccatttgaccgggcagatccgcgacatcgccgagcagaccaatctattggcgctgaacgcggcgatcgaggcggcgcgcgccggcgagatgggccgcggcttcgcggtggtggccgacgaggtgcgcaagctggcggaaaactcggccaaggccgccagcgaaatcaagggcgtgaccgaacaactgagccagaacgcgcaatcggtgggctcgacggtgcaaagcggcctggacgccgcccagcaaagccgcgacaccatggagacggtgatggccaatctgcgcgaggccaacgacagcgtgcaagaagccagcggcggcgtcggccagatccgcgacgccatttccgagcagaaaagcgtctgcgccagcctggcgcagcgcttcgaaacggtatcgcagatggtggccgacaacacccaggccgccggcgaactgcacagcgcggtgctccgcctgaacggcgtggccgcccacatgcagcaaatggtgggcaagttccagctgtagcgccgccaaggctagcgcgggcgcaacgacgcgatgcggctcaggcggagaaaacgggattcgcggcatccagccggaagcgcagcagcgtccccgcatgcggcgccagccgccgcgccagccaatccatgccgaccgcgccggacgggaagccggcgtccgggcgttcgctgacgaacaccacgttgcggctggcttcggtcagcttgaaatggtccgactccagccaattcatgcagcggcaaaccgtctcccggccgccgttcagccacaccacctcgccggcttgcggccactccgcttcggcgcggcccaacggcacgaaggcttcgtcgccatgcgccaggtccagcagcagctctccgcccagcttgtcgacatcttcgccgccaaacggcaccaggctgagcaaggacgcctggttgtacagatccaccaacggcaggatgctgcgcagcttgtccttttgcaccgccttgaccagatattccagcgaacagcgcgccttcttgtcgccgggcaactcgcggtacagcgctttccagcgctgcagcagcgcttcggtatccgccccttccgccaaactcggcgccgccgtcggcaaggccgacgtttgcagatccagggccagcaggccctccacttccattgccggcaggcggcccaacaggtcttggctcaattcgacgcgcatcgctttctccctcatgatcagtgcgctgcctatgctagccaggctgtggagcgaggggaagcaaatgcttttaatggggcattagtaggagggagccgatggcttgcaggcggtgcgagagcctctttgccccgcgggagaggggttggcgagagggcggcttgcgcgcccagcgggcggatcgcccctgccgggcatccgccctaacgcatcaggcgctcagcgcctcgcgccgcgactgcgcgcgcgccgccagccaggcgtccaccacctccgcagcgttggccggcagatgcagtttcagcttggagcggcgccacaggatgtcctcgctgcgcgtcgcccattcctgctccgccagatattccagctcggccgcatagaggccgggcagcacttcctcgcccagctccgccaggctggcggcctggccgatcagcttgccgacgcgggtaccgtaggcgcgcgcccagcgctcggccaatgccgccggcagccatgggcagcgctggcccaggccctgcaggaagcggccgaagtcggcgcccggcatgtcgccgcccggcagcggcgcgtcggcggtccaggtggccttgcggttgcccaacagcggcgccagcttgtccaccgcctcctcggccagcttgcggaaggtggtgatcttgccgccgaacaccgacagcagcggcgcgccggcgaggtccatttccagcgcgtagtcgcgggtgacgctggcggcgttgtccgcagcgtcgtccagcagcggccgcacgccggaataggtggacagcacgtcggcgggcgcaatctggctgtggaaatagcggttgctcatctcgcacagataggcgatttcctgcgcgtctatcgccacccgggccggatcgccgcggtactcgacgtcggtggtgccgatcagggtgaaatccttctcgtacgggatggcgaagatgatgcgtttgtccggattctggaagatgtaggcgaacgggtggtcgaacagcttcttcaccacgatgtggctgcccttgaccaagcggatggacttgctggacggcatcgccagcttgtcctcgatcaggctctgcacccaggggccggcggcgttgaccagcgcgcgggcgcggacctcgaagcggctgccgtcctcgcgcgccagcgtgacgatccagtggccgtcgtcgcggcgcgccgccacgcaggcggtgcgggtgtggattttggcgccgtgctcggcggcgtccaccgcgttcagcaccaccagccgcgcgtcctgcacccagccgtcggaatagacgaagccgcgcttgaacgcgtccttcagcggcgcgcccgccggatgcttggcgaagctgacggtttccgaccccggcagcacttcgcgcttggccagatgatcgtagaggaacaggccggcgcggatcatccactcaggacgctggtcgcgcgcgtgcggcatcacgaagcgcagcggccagatgatgtgcggggcggccttcagcagcacttcgcgctcctgcagcgccttgcgcaccaggccgaactcgtaatactccagatagcgcaggccgccgtggatcagcttggtgctggccgacgaggtatgcgaggccaggtcgtccttttcgcacagcgccaccgacaggccgcgcccagccgcgtcgcgcgcgatgcccgcgccgttgatgccgccgcctatcaccatcaagtcgtatacgtccattgcccgtccttgcttaatctaccgtgttcattctatccacaatagctaacaagcaacacaaataacacatttttctttcgctatttttcgtttttacgacactttggcgggatgcaatcaggaaaggcaggaaaaggcggatgggaggctccgggcgaatcggcattccagccttgcggggcaaggtttagcgacggattgggagcagcgggacgcgcaggcgcgcggagagggaaaaacgaacaaaaaaggaaaacggcgcgccggatagcgcgccgtcgactgcgattacagcgtggaagccagcgccgccagcgtgccgccgatcaacgagcccagcaccggcacccaggcatagccccagtcgctgtcgcgcttgcccggaatcggcaggatggcgtgcatgatgcgcggcgccagatcgcgcgccgggctcatcgcgtagccggtggtgccgcccagcgacacgccgatgcccagcaccaagagagccaccggcaatgcctcgatggcgcccagcgacattttcgggccgaccatcgacaggatggcgaacaccagcacgaaggtggcgacgatctcggataccaggttgcccggcaggctgcggatggccgggccggtgcagaaggtggccagcttggtgtcggcgcaatcggtggtttcatagtgcttgcggtagatcacccacatcaggccggcgccggccatgccgcccagcatctgcgcggcgacatagcccggcaccttgtcccacgggaatttgccggccaccgccagcgccaccgacaccgccgggttcaggtgcgcgccgctgatcgccgccacgctgaacacgccgacgaacaccgccatcgcccagccgaaggccaccacgatcaggccgctgttgtggcccttggtgtttttcagcagcacattggccaccacgccgttgcccagcagcaccaacagcgctgtgccgatgaactcgccgaccaacgctttgtaaaatggatccatgattcagtctttcagaaaagagattggcgtcccgccgcggctggcgcggcgggcatgcttgtcgctgggcaatcaagcctgatcgtcggcccacaccttggcggcgttcaccgcgcgctgccagcccttgacgttggcggccacttcgccggccggcatcgccggctggaagcggcggtccagctgccattggccctggatgtcgtcgacgctcttccagtaaccgacggccaggccggccaggtaggcggcgcccagcgcggtggtttcggtgatcttggggcgaaccacgttcaccgccaggatgtcggactggaactgcatcaacagctcgttgacggtggcgccgccatcgacgcgcagctcggcgatgcccatgccggcgtcggcttccatcgccttcagcacgtcgcgggtctggtaggcgatgctgtccagcgcggcgcgggcgatgtgggccgccttggtgcccagcgtggcgccgacgatggtgccgcgggcgctggcgttccagtgcggcgcgcccaggccggcgaaggccggcaccaggtagacgccgtcgctgtccttcacttcctgcgccagcgggccgacgtcggccgagtggcggatgatgcccagaccgtcgcgcagccatttcaccaccgcgccgccgatgaagatcgagccttccagcgcgtactgcaccttgccgtccactgcccaggcgatggtggtcagcagattgttcttcgattcgatcggcttgtcgccggtgttcagcatcatgaagcagccagtgccataggtattcttcaccatgccgggctgggtgcattgctggccgaacagcgccgcctgctggtcgccggccacgccggcgatcgggatttccacgcccaggtgggcggcgtgggtgtggccgtacacctcgctggagctcttcacctgcggcagcatcgaggccgggatgcccatgatgtccagcagctcggcgtcccattccagcgtgtggatgttgtacagcatggtgcgcgaggcgttggacacgtcggtgacgtgcactttgccgtggctgaagttccagatcagccagctgtcgacggtgccgaaggccagcttgccggcctgcgcgcgttcgcgggcgcccggcacattgtccagaatccatttgatcttgctgccggagaagtaggcgtcgaccagcaggccggtcttggcgcggatcagctcgcccaggccgcgcgccttcagttcgtcgcagaagccggcggtgcggcggtcctgccagacgatggcgttgtacaccggctggccggtttcgcggtcccagacgatggtggtttcgcgctggttggtgatgccgatggcggcgatgctgcgaccgtcgatgccggctttggccacggcttccgccgccacccccacctggccgccccagatttcctgcggatcatgctcgacccagcccggttgcgggtagatctggcggaattccttttgcgccagcgacacgatgtcgccgccgcggttgaacaggatggcgcgggaactggtggtgccctggtccaaggccagtacgtactgatcgctcattgagtcttctcctgattgccggcaaggcagcatggttaacagcgggggtgtcaacgttgcgctaatgttgctttttttgcttatgacgttcgttttatttgcggacaattctattcccgaacaccagcttgtcaatcattcggtaaaaaaaaatacattttccgcagcgcaaccaggcttttcccgcgtgacgaacccatttttatccaattaaatcaaagcactgaaaaatgtagcgcgatgctacattccgccgacgacgcggccattccggcacgaaccgccgcgaaccacgcggctagcggcggccccgcgccgcgtcctggctgcgtttgcgcgtcatccgtcgtccatcactgcaattccgcactgcaacaaggctttgcgcgattacatcctgatttttgcaaaggaaaaaataagaaaataagcgaaaataaagatggcggattagaaaaaaacaacaccatcaatcgttgttttgcgcgcaaatccttcatttcaagtaatccagccgctacacggcagttatggcagcatgatcgacaacgccggagacagcctgaacagcctgccgatgcgcgctgcgcgccgggcaaggcgagcggattcgacccaacgcaaagaagccgtcgcgcggacatggcactatcggtgcagacgacgccggacgccgacggcgcggggaaacgaatcccggcgcgccgacgcccggcgcagcgtttccggctccatgcccatagcttcaacctaaccggccggacggccgcaaaggacagtcatgcttcgcaacaccaaaattctcgccacgctggggccctcatccagcaccccggaacaaatcctggagctggcccgcgccggggtgaacatcttccgcctcaatatgagccacggcagccatgacgaccaccgcgcccgcctggccgccatccgcgccgcggaaaaggcattggaccggccgataggcgcgctgatcgacctgcaggggcccaagctgcgcatcggcaaattcccgcagcccgccaccgtgcagaccggcgaccgctacgaattcgtgctggatgaagtggacggcgacgcccgccgcgccagcctgccgcacccggaagccttcgccgcgctcaagcccggccacagcatcctggtcaacgacggcaagctggcgttccacgtggaacatgtcgagccgcgccgcatcgccacccgcgtcaccgtcggcggcgagctgtccagcaacaaaggcttcaatctgccgcacaccgtgctgccgctgtccgccatcaccgagaaagaccgcaaggacgccgagttcgcgctggccgaaggcgccgactgggtggcgatgtccttcgtgcagaccgcgcgggacgtggccgagctgcgaaagatcgtcggcacaaaggccggcatcgtcgccaagatcgaaaaaccgtcggcggtggacgatctggaagccatcgccacgctggccgacggcgtgatggtggcgcgcggcgacctgggcgtggagctgccgccggaagacgtgccggtggcgcaacgccgcatcgtccaccagtgccgccacctgggccgcccggtgatcgtcgccacccagatgctggagtcgatgatcaccgcgcccacccccacccgcgccgaagccaacgacgtggccaccgccgtctacgagggcgccgacgcggtgatgctgtcggcggaaaccgccgccggccaatacccgctgcaggcggtgcagatcatggaccgcatcatccgccgcgtggaaagcgcgccggactaccgcaaggtgatggcgctggactacagcgccgccgacgagccgggccgcaccgacgccatcgccgcctgcgtgcgcaaggtggcgacgctgctgccggtgacggtctcggtcgccttcaccaccagcggctccacctgtctgtacctggcgcgcgagcgcccgtccacgcccatcctggggatttctcccagcctggacaccgcgcgccggctgacgctggtgtggggggtggtggcctaccacggtccggatgcggaaaacctggaagacatggtagtgaagaccaccttctgcgccaccaagctgggcctggccgaacagggcaagccgatggtgatcatcgccggcgtgcccttcggcacccccggctccaccaatctcttgcgcatcgtttacccgtaagcgccgcgtcttcgcgcgcttaagacaacggaagcccgccggcttccgtttttcatttccgccggcgcatcgccggcgccgccaagtactatgctgcaaccatggccatactcgctgatcccaccccatgcggcagaagcttttccccaccatgctggcgctatggctggccctggccggcgtccccggcctggccggcgaaccgcccggactgatcgtcgacttcgacgccagcaatccgccgctgatgtacgccggccagcaaggcgccgccggcctgtacccggcgctggtcgccaaggtctgcgaacgcgccggcatcgccgtcacgctgcgcgccgcctcctggcgcctggcgctgcaggaattgggcggcggcagcgcagcggccggcggcatcatcaagaccgccagccgcgaaaaactgttcgacttcagccagccgctgttctacgagcgcgtggtgatggcttctccggccaaggcgccgcgctaccgcaagcttgaggacctgtacggcaaaagagtgggcgtgatggccggctggagctacggcgacgccttcgacctggccaggaagcaaggccggctcaccgccttcgacggcgacagcgacgagcagaacctgcgccagctgcgcctggggcggctggacgtggtgttgggcatacgcgagccgctgcagctggcgctacgcgacggcggctaccgcgacgtggcgctgtcgcaggaggcgctggtgaccaatccgtcctacctggccatcaacaagcacgcgcagcaagaggcgctgctgacgcgcttcaacctggcgctggaagcgatgcgccgcgacggcagctacgacagcgtgctgcagcgcgagctgtccaggcgctgaaccggacgccggcctgcgccgcgcgcgcgaccgcgcccgcctgccaccgcccctgccatcaaaaactataagtgctgacctcgatcagattgccgtccgggtcgttgaaatacaccgaggtgatcgttcccatcgcgccgctgcgggtgatcggcccctcgacgatggccaccccttcgcgcttcagatgctcagccacctcggccaagggcaaatgggtgatcaggcacaggtcgccggaaccgatggcggcgtggttgcgcgtttcctggcccaaggtttgcaaattgatcttctggttgccgaaacgcagcgcgcggcggccattgccgaagctcaccgcttccagcttcagcgcgcgctggtaaaaggcgaccgccgcctcgatgtcgcgcacggtcaggacgatgtggtcgatatggctgatcatgccagcaactccggtggaaagtatggaccatccacactgccacaagccggccggcctgtcatgccgaaagcatggcggcctgacggccgccgcctcccctgctatagtcgcctctcagactttctccatgccgaaaacatgaccgtgcacctgccgctgcaacaagcccgccacctgcaactggccgcccagggcctgctgaccgcgccgcgccgcaaggcgagcaaggccgacgcgctggccgccatccgccgcatggcgctgctgcagatcgacaccatcagcgtggtggcgcgcagcccctacctggtgctgtacagccgcatcggccagtacgacccggcctggctggaccagctgctggccgaaggcgcgctgttcgaatattgggcgcacgaggcctgcttcgtgccgaccgaggactaccggctgctgcgccaccgcatgctgaacgccgagggcatgggctggaagttttcgccgcgctggtacgcgcagcaccgcgccgacatcgaagccatcgtcgagcgcatccgcgcgcacgggccgatgcgctcggccgatttcgagcgccgggacaacaaaggcaatggctggtgggactggaagccggaaaaacgccacctggaggcgctgttcacgctgggccggctgatggtgaaggagcggcgcgccttccagcgcgtctacgacctggccgagcgggtgctgcccggctgggacgacgcgcgcgacctgctctcgccggaagccgcgcggctggaacaggtgcgcaacagctgccgcgcgctgggcctggtcaaaccagcctgggtggccgactactaccgcctcaagcgcgcgccgtacaccgagctgctgcatggcctggcggatgccggcgaactgctgccggtgaaagtggaaggctggagccacgacgccttcgtccacgccagcctggccgccgaactggagctggcgcgcaatggcatgctgaacagcggcaacaccgccatcctgtcgccgttcgacccgctggtatgggaccgcaagcgcgcgctggagctgttcgatttcgattacaagatcgagtgctatacgcctgcgccgaagcgaaagtacggctatttcacgctgcccatcctcaaccgcggcaagctggcgggccggctggacgccaaggcccatcgcgcgcaaggcgtgttcgaagtgaaatcgctgcacctggagccgggcacgcgcgtcagccagcggctggccgacgatctgaaaacggcgctggccagattggccgattggcacggcgcgccgcggctggcgataagccaggcgccgggcgacctggccgcgcgcatcctggcctgacgcttactgcgcgttggcgtaccagccgctgacgccgggctggcgctcgtcccacagcgccacttcgctgaactggatgtcgggctggatgtcggtgtaattggcgatatcccccatgatgcgcgccgccaccgggccgaaggcctgctgaaaggcctgcaccgaatcgcacagcagcagggcctgcgccacgaagcccggcgggctgcccgcctcggcgccggacaggccgcggtccacccgcacgcccttcaggctatggcccagcaattgctgcaccatcggcatgtggcgctgcaggtagtagtcgaaatcgaaacgcgcggcgggccgatgcggatagacgacggacacgacgatcatggcaagctccggttgtgcacaaggaaaggcttaacttactcgcctggtcaaaaattgccaatgtcatttagcatggcgcggcggcgatggaacttgcccgccgccgccgctctctatccttcaggcaaaccacccgaacggatagacgcatgcgcaccccgatactcctgatgagcgccgccctggcgctggccggctgcgaccagcgccaaaccgcccagctgcagcaggccgcctccgccgccatcggcaatgtgcaccagggcgtcgacgccgccagcgcgccgctgggacagctgaaggagcaagccagcgccgcgctgggggcggccaagcaggtgggcgcggccgccaccctgctcaatcccgaactgaaggaacaagtggaaaaactgaagcggcaggcgtccgacatccagggcgcgatccagcccaagccctagccgccttaacggcattttgatggccgggcgcggtttatttagcttgaatttagaccggccgacctagcatgggcttgtcattccccctggagaaatccgtcatggaaagcctgcccgacttgtgccgcgtcagcgacatcctgctggatgtggacgttgactgcaaaaaccagctgttcgcctacgccgcccgccagctgggccaacgccacgcgctgaacagccagaccgtgcaaagcgcgctgcagctgcgcgagcaaaccggcagcaccgcgctgggccacggcctggcgctgccgcacgcccgcattcccggtctgagcgaagcccatgcgctgtttctgcgcctgaagcgggacatggagttcgactcgcccgacggcaagccggtgcgcagcctgctcttgctgctgctgccgcaggaagcgcatccgcagcacttgcagctgctcgccgccatcgcccgcatgtgcagcgaaaggccgttccgcgaagcgctggcgcgctgcgcccacccgcagcaggtgcaccagttgttccagctgtgggctgacccgcagcccagcaacgacccgcacttctggctggacagcaaccgctacttcctggacaccgaagccagcctgcggcccgattacagcatacggcgcaaagtggtggcgcgcttctgagccgggccggcggaaaaccgggcgggtgacagcggaaaaccggctttgctaggattaaaccgctaccgcccctatttccgacaaggcctgaatgtccaatttcctgctcaccatgctctccctgaccgtcgccagcataggcgtgatcacctggcagcacagcgtgcgcgccgatttgctgcggccgcgccgccgctggctgcaggcctcgctgctgctggccaccgggatgatgctggaaggggaactgctgggtctgcacccggcggcgctgtcgctgggcagcggcatgagcaacgccggcatcacgctgcagctgatgatcatcgcccggctgtgcaatctgcgcctgcccgatacgctgtggctgtgggtgggcgcctattcgatcctggacaagtgggtgccgcagccgctgctgagcgccgcgctgtcggcgctggaaatcccgttgctctacctggccgccgcctggctgtaccaacgcgccgaacagcagatctgccacaaccgcttcagccccaccgcgctgctgttcctgctgggggcgctgctgttcatctggcgcgacgcgcccgacctgctgcggctgtaccacggccagccccacctgtcgcacgagcacacgctggcccaccagctggcgctgaccgtggccgccgccgcccaggtatgcggcgcggtgggctttctcaacatcgtgctgcaacggcagaacagccggctgcaggacgccgccaacatcgacccgctcaccgccgccggcaaccggcgcgcgctgcaatactggctgcgcacgctggaagcctcgaccgagcgggtctgcgtgatcatgctggacatcgaccatttcaagtcgatcaacgaccgcttcggccacccggccggcgaccaggtgatccaggcgctggccagcctgctcaacaacggcgtgcgggaaaacgatttgctgatccgctacggcggcgaggaattctgcctggtgatgccggacaccggcatcgaaaccggcctggcggtggcggaccggctgcgccagcaattcagccagctggcgctgttgccggcgcagccggagcagcgctgcagcttttccgccggcgtgcacgaatggcaatgccggcagcaggatttcgccagcgcgcagcaaaaggccgaccaagcgctgtaccaagccaagcagaacggccgcaaccaggtctgccggctgtagtcagcggccggcgggcttgtcctcgccatcctcccggtgccgcgacttcaccgcgtacatctgctgatcggccatccccaccagcgcttccgggctggcgaaatcctccggtccggtttcgacgcagcccatgctcaccgtcacgccggacagcgcgatttccatctcggcgcgcagacgctggacgaaattgttctccgcgtggcggcggccgcaattgggcagcacgatgcagaattcgtcgccgccgtaacgaaagcagccgtcttccagccgcgaaatgcgattgatgatgccgcccagcacgcgcaggatctcgtcgccgcgctgatggccttcggtatcgttgatcgccttgaaatcgtcgatgtccagatacaccagcgccaccctttcatggcgccgctgcgcgctgcgcagcacccgggtcagggtttcgtccaggtggcggcggttgagcaggccggtcaacgggtcggtgcgcgacagctcctccagctggcgggtgcgcatcgccaccttttcctccagcgccagcgcgtactgctcggacttgttgcgcgaggtttcgatttccgccaccaggctgcggatataggtttcgaacaccagcgcgatgtcgaacatcaccagcttgtccatcgacatcagcgtctgcgtgcagacatcggggtcgggaatcagcctggccacctgcaccgacaacagcgagcgcaggaaatggatggccgccaggtacaacttgggctccacgccgatgcgcttgtgcaccaggccgatgcgcaggcggttgttgacgtattccagatcgtagacgccgctgaacaggtcgatcacgtagcggcgctgggcgctgcgcagccgctgcagggtatcggcgtcgccgatcagcagcgcgatttccggggtgctggtctgctgctcgtaaaagcgctccaccagatcgtccagctgcggctcgatcagcgcgccggcggcgcgaagcagcaattcgtcgcgcggctgcagatcgaacagctgcttgcgctggtcgatttcaaactcggtgatgcgcaactgctccagcaacgtctggtcggtctgcttcatgcagccctccccctccatcatgaccggtcttattcaaactatatcccagcctgcgggtacgcaatctccttagcggcgcattgcgcgcgccagcgaacgcgcctgggtctacatcgccgtctgaacggcgcggacaacggccggcggcttatccacaggcaaccggcggtctgcctgtttatccacagcttcagccttcggcttgctgcagcagcaccgccagctcgtccgccgcctcgctccattcggcgtcgcactccagcgcctggcgcaaaaaggccgcttgcgacgggctccagaacggcgcgtcggccagcgacacgcgcggcggcagcggatggctggcgatgaaggccttgatcgccgccggctcgtcggccaggcccaactggcggaacaatccgggcaacaggtggctgctggtatccatcgcgcgctccaatgctgggggaatacgctcatcctagactgattgccggcacggcaggcataaaaaacggcggcccgcgccgccgttgtgccaacttggcgacatcacaccttgtcgtacagcttggcgccgcccttgacgaactcgatggacttttcctgcatgcccttgttcagcgcgtcctgcgcgctgatgccctgtttggcggcgaaatcgcgcacgtcctgggtgatcttcatgctgcagaaatgcggaccgcacatcgagcagaaatgcgcgaccttggcgctatctttcggcagggtctcgtcgtggaagtcgcgcgccttgtccgggtccaggcccaggttgaactggtcttcccagcggaattcgaaacgcgccttggacagcgcgttgtcgcggatctgcgcgccgggatggcccttggccaggtcggccgcgtgcgccgccagcttgtaggtgatgatgccttccttgacgtcgttcttgttcggcaggcccaggtgttccttctgcgtcacgtagcacagcatggccgtgccgtaccagccgatctgcgccgcgccgatggccgaggtgatgtggtcgtagccgggcgcgatgtcggtggtgagcggccccagggtgtagaacggcgcttcgcggcaccactccagctccttgtccatgttctccttgatcagctgcatcggcacgtgcccagggccttctatcatcacttgcacgtcgtgcctccaggcgatttcggtcagttcgcccagcgttttcaattcgcccagctgcgccgcgtcgttggcgtcccaggcgctgccggggcgcaggccgtcccccaggctgaaggccacgtcataggccttcatgatttcgcagatttcctcgaaatgggtgtagaggaagttttcctggtgatgcgccagacaccacttggccatgatcgagccgccgcgcgacacgatgccggtcatccgcccggcggtcagcggcacgtactgcaaacgcacgccggcgtggatggtgaagtaatcgacgccctgttcggcctgctcgatcagcgtgtccttgaagatttcccaggtcaggtcttcggccttgccgttcaccttttccagcgcctggtaaatcggcacggtgccgatcggcaccggactgttgcgcaaaatccactcgcgggtttcgtggatgttcttgccggtggacaagtccatgatggtgtcggcgccccagcggatgccccaggtcatcttgtccacttcttcggatatcgacgaggttaccgcgctattgccgatgttgccgttgattttcaccaagaagttgcggccgatgatcatcggttcgctttccgggtgattgatgttggccgggatgatggcgcggccggcggccacttcctggcggacgaactccggcgtgatctcttccggcagattggcgccgaagctctggccggcatgctggcgcgtcatcagctccagcaagcgggtgttgccggtggcctgcagcgcttccacataggcgcggcggttcaggttttcgcggatggcgacgaactccatctccggggtgatgacgccgcggcgggcgtagtgcatctggctgacattgcggccaggcaaggcgcggcgcggcttgcgctgcagattgaagcgcagctcggcgagcttggggtcggcctcgcgggcgcggccgtattcgctggacaggccatccagctgctcgcagtcgccgcgttcggcgatccagccggcgcgcaccggcgccaggccgctctggatgtcgatgcggaccgccgggtcgctgtacgggccgctggtgtcgtagacgtagatcggcgggttggcttcgccgccgaactgggtcggcgtgtcggcctggcggatctcgcgcatcggcacgcggatgtccgggcggctgccggcgacatgaatcttgcgggaattgggcaaaggctggatggcggcggcgtccaccaccatctgtttgtttacgggcgcgttcatcgggcgggtctccagggcgatgaagcggcgcaaggagcggttcggcgcatggccggctgcggtgggatggcggggctatcttcggcaggtgacgcttccctacgccgggattatccgggtcaggttccaagggtatttctcacccgcgccgccgctttcaacccgatgtcctacactttggtagccgatcaagccaaacgccaggcgcaggacccctagcgatgctgtgaaggtaaggcaaatatgggataatcgcaagttatcgtcatgacacgagtccttgccgccccccagcttcgaacggcgcagcggactcccagccctccggagtttaagttgatggatttcgaaaaaacccgtttcaacatggtcgaacaacagattcgcccgtgggacgttctggataccaacgtgctggatctgctgtttcacgtgaaacgcgaggacttcgtggccgacaatcagcgccagatggcctttgtcgataccgaactgccgctgcccaacggcagcaagatgctacagcccaagatggaagcccgcctggtgcaggacgcctccatccagcccaccgacaagatcctggaaatcggcaccggcagcggctatctgaccgcgctgctggccaagatgggcaagcaggtggtgagcgtggaaatcgacgcggcccagaaagcgcgcgccgccgaaaatctgaaacaggccggcatcgccaacgccaccctggttgagggcgacggcgtgctgggcctgccggcgcaagcgccctacgacgtgatcgtggtcggcggttcgctgccggtggtgccgcaggaactgaaagaccagctggccgtcggcggccgcctgatcctggtggccggcgacctgccggtgatggcttgcaagctgatccagcgcgaaaccgaaaccagcttccgcgaaaccgcgctgttcgagacctgtgtcgagcggctgcagaaattcgaagccgtcgaaccggctcgtttcagcttctgaccatgctgcgcgaaatcaccgctccgcaactggcggcgctgctggccgatccgcaggccgcgcgcccggtgctgctggacgtgcgcgaaggctgggaataccagctggcgcacatcgagggcagcgtccacattccgatgaacctgatcccgatccggatgagcgaactgccggacgacgccgccatcgtcgccatctgccatcacggcatgcgcagcgcccaggtggcgatgttcctgcagaacgccggcttcgacgacgtgatcaacctccagggcggcatcgacgcctggtccgcccaggtggatccggccgtcgcccggtattgatactggactagacggcgcgtcgcccattggggtgacgcagcctaccagcaccgcctccgggcggtgttttgcttggaacgaaacgccgcccgccgcctccaagggtcgtgatccgccactcccgccgcaaagaaaccctatgcaagctctgaattatctttcctccgccctcgcccgcgtccatccggcctgggaagcggtgctgcgccaagccgacatcgccgcgcggctggccgacatcgaccgccagctgagccagcaaagcgaggccggcaagacgctgttcccgcccgcggcgcagatcttcaacgcgctcagcttcgcgtcgccggccgacgtcaaggtggtgatcctgggccaggacccgtaccacggcgccggcgaagcgatggggctgtcgttttcagtgccggaaggcgtgcgcgtgccgccgtccttgcgcaacatctacaaggaactggcggccgacctgggcctgggcattcccgccaacggcgatctcagccactgggcgcagcaaggcgtattgctgctcaacagcgtgttcaccgtcgagcaggaccaggccggcagccacggcaagctgggctggcagacggtcagcgacgcgctgatcgacgccgtcaacgcgcaaagccccggctgcgtgttcctgctatggggcaactgggcgcagaccaaggccgagcgcatcgacgccagccgccacctggcgctgaaggccgcccatccgtcgccgctgtcggccagccgcggcttccacggctgccgccatttctcccaagtcaacgcctggctgatcgcccgcggccgccagccggtgcgctgggccgccgccgccgcgcaaaacagcctgttctgacctttctgtccgccgcggcgctttgcgcggcggacggcttgccctaagctagtagctccgccacttccctgtccccatcgtggaaatcctgctgctgctgggcctgatcctgttgaacgccgtattcgcgatggccgagatcgccatcgtctcctcgcgcaaagtccggctgctgcaaaaggccgaagacggccaccgcggcgcccgcgcggcattggcgctggccgccgaacccacccgcttcctgtccaccatccagatcggcatcacctcgatcagcatcctgtccggcgtctacggcgaggcggcgctgtccgagcatctgcgcgccgcgctgctcgaggtgccgctgctggcgccttacagcaagccgctgtcggtggcgctgatggtggtgttcatcaccacgctgtcgctaatcctgggcgaactggtgcccaaacggctggcgctgctcaatccggaacgggtggcgatggcgctggcgcggccgatgctgctgctgtcgcgcgccagcgcgccgctagtgcaggtgttcagccgcgtcaccgacggcctgttgcgcctgttgggcgccaaaaagagcgacgagccgtcgatcaccgaggacgagatccgcacgctgatggaacaaggcgccgacgaaggcgtgttcgaccgcgccgaacaggagctggtggaaaacatcttccgcctggacaaccgcaaggtggcggcggtgatgacgccgcgcaaggacgtggtgctgctggacctggaagacggcccggagcacaaccgcgaactgctgctgcggcacaacttcagccatttcccggtttgccgcggcgacagcgaccaggtgataggcatactcaacgccaagcggctgctggaccggttgctcaccggccagccggccgacttcgccgccgacctggcgccgccgctgtacgtgccggccacctcatcgctgatgcagctgctggagcagttcaagcaggcgcgcagccacagcgcgctggtggtggacgaatacggcgagctggaaggcctggtgtcgatcaacgacgtgatggaagccatcgtcggcgatatgccggccatcggcggcgaagacgacgaaatcgtgcagcgcgaggacggcagctggctggtggacggcatggtgtcgctggacagcttccgcgaattcttcgagctggacagcccgctgccgggcgaggccggcggcaatatccacaccctgggcggcgtcatcatgttcaagctgggacgcatccccagcgtcaccgatcgtttcgagtggaacggcttcagcttcgaggtggtggacatggacaagacccgggtcgacaagatcctggtgcagcgccgccatctgccgcaaccggagttcgagtcgatttgagtacggcggcggacggcgggaaactcgccgccgcgcaggcgatctgacaaccatcgaccgcttcccgccgagacttcatgaccccagccctgcccgatcgccgcgtcgtccaggccgacgcgcgccgcctcgccgactggcttcgcctgcgcgcggcgctgtggccggattgtcccgccgacgaccatcgcgcggatatctcccgccaactgacgcaaaccggccgctacgccgcctttctggcgcttgatgccggcaacgccgtcgccttgctggagattgcgctacgcaacgattacgtcaacggcgcccgctccggctcgccggtggccttcatcgaaggcctctacgtggcgccgcggcatagacgcgccggactgacgaccatgatgcttgccgcggccaaggcatgggcgctgacgcgaggctgttccgaaatggcctccgacaccagcctggacaacctggcggcgcaggccgcgcatcgggcgctgggcttcgaggaaagcgaacgcgtggtgttctaccgcatggcgctgtgatgctttgctcgtcgcgctgatgccccagcggggcgatctgccgccatctcctccactctgcgcataggcgtaacacccggcgagccgggcttccgccctacggcgccggccgctggctgagcctggcccggccttcgccgaaaacttccaacacggcccaggcgccgttcagcaggctccactgtggcggcgagtggccgatgtctgcgtccatcgccaccggacagcccaagccatccagcgcggcgcgcaccgccgcctgatacgacaaagcccccgcgttggcggcctcagggcccgtgctgcggcccaacaccagcccggacaggccatcgaacgttccggacagcctgaggcccgccagggcccttaaaacgccgcagggcgcgagttcgcagttttccaggtacaggatggccggcttgcgcttgaaggccgccagatcgaaatacggcgtgccctgcagcgatgccagcacgtccaggcagccgccgatcagccggcctgccatttttcccgctccgccgtccagcatccgcacttggttggcaaaggtctggccaggctcgtcccagcgccagtaacgcgcgtattgctcctgcgccgccggcatgccggtttccaacgccgccagcagcgcctcgtagccggattgcctttctttcagcggcgaatccatcaggttgggcccgtgcagcgtggcccagccggacagcagggtcagcggcgccagaagggtggagacatcggagaagccagccagccatttcggcggcagcttggccagcgcggcgaaatccagccccgccagcagctctatcgccagttcgccgccccagggcggcaggatggcgcggatgcccggatcgaacaggaaacgcttcagttcggccaaccgcgcggcggcgggcgcgctggcgtcgcatttctcctcgcgcaggcactcgccctccaccacccggtagccgcgcgcgcgcagcatggccagcgcatcatccagctggttgtgcagctgcgcaggaaccccggaggaaaaggcggtgacggcgatggcgtcgccaacctgcaacggcgccggaaaacgggtctgcatctgtggatttccttccagcctggactcccgcctgtggataagccgcgcttcaagcgcgccgcggcagatccagcgcgaacgtgatgccggtgtttttctgctggtagccgatacggcggtagaacgcgtgcgcgtccagccgctgttgtcccgagcgcaggcggatgcgcggatagccgcgttcttgcgcccaggcctcgcaggccgccagcaacagcctgcctatccccaatcccctgtgttccggcgccaccacgatgccgccgatttccacatacgactccgcttccagcagatggccgccatggccatgcgcccaaccggccagctggccgtccttttccgccacccagatctcgttgtcgggaaaggcgcgcaccgcggcgtagcgccggcccacctcttccgcgctgctcgggtaatccagatcgccgcacagtttggccaccgcggcgatatcggtttcccgcatggttctgatcaatatcgacatctcgtcatcctgtcatgccaaagacatgacattctgcatgcgacgcgtcgcggcaacaaacgcggcggttcacgacatggctccggcagcggcggaatcggcttgcgctgcaaccagacgccaatcgtcgccatcccgggtttcatgcgcgatctctgtgcgtttctttctatcccattgatagatagaaggaaaaatgcacgctcagctagctggcaggctggctttccgttgccggagccgccgatcagcggtcagtacaacgcggggaaagtggataactttccgctgataggtgcaggctatcgagcagttcccccttcggcttgggtgatccacaagtcttgccatgttttccaaaccacgtccttgcagacgttttttcctgttttcccagagagttgtctgtcttgagtccagccttgttctgccttgccgtttcttttcttgtattcccatttttatattgaagaaactggtagaagatggcccagtcctgttgataagtatatttatccgtttaaattcaatatcttgatcgtgatggaaagttgttgtcagccatggttgttgcgtgctggctagttgtggataagtttggtcttttctgcagacaggcagttttccacatgctggcaacgggaagtgcccttgttgctgtgaacggttttttttgccgcccaagtgtccattcctcaccgttgtttctttaacgcagctataaaatgatgataatgctgaaggcggagaatattgtggacaatcctgaaaaatccatgattttcatcatcttgtcctgttgatagccatgggattattgcagcgcgcaaaggctgggcagattgtggataaatccgccgccgcttatcaacagctgtttatccacattccttgcggagggattttgcttggttaaccacagccctgctcgggtacaatgcccgccatgatgaatgtgctgattgtgcgcacctcgtcgatgggcgaccttatccacacctggcccgccatcaccgagctgaaaacgcattaccccaatatccggctgagctggctgaccgaggaaagcttcgccgacatcgcccggctgcatccgcaggtcgccgaagtgctgaccctgcgctggcgcagctggcgcaagcgtttgctgcagcctgccgcctggcgcgaactgaaggcgctgaagcggcaactgcgcgacacccatttcgacctggtgctggacagccagggcttgctgaaaagcgcgatcccggcgcgctgggccgccgcgccgctggccggcctggactggagcagcgcgcgcgaggcgctggccagcctgttttacgacaagaaacattcggtatcgcgccggttgtcagcgatagaacgcaaccgccggctgttcggcctgagcttcggctaccagccgcaaggcgagcctagcttcggcgtggcggccggagagcggccgtcgtggatgctttccggccgttacgcggtgctgctgcatgccaccagccgcgcctccaaggaatggccggaggcgaattgggtggagctgggcgaacgcctgtccaatcagcacgacatggtgatggtgctgccctggggcaacgacgctgaaaaagcccgcgccgaaaggctggccgggcggatgccggccgcggtggtggcgccgaagatgagcctggtggaagccgccggcttgctgggccatgccagcgcggtggtcggcgtggataccggcctcgcccacctggccaacgcgctgaacgtgccattggcggcgatctacaccgataccgatccgcagcagaccggcgtggtggaaacgccgtgggcgaccaatctgggcaatatcggccagtgtccgcaggtggatgaggtgctgcgggcgctgcgatcgcggcgggactggacgtgagctggcagcgctgcttgtacggcgcgctgtggcggacgctgacgccgctgatccgccgttatctgagaaagcgcgcgaaacaggcgccggcctatctattgcactgggacgagcgtttcggccgggtcttgcagccgcgcgccgtcggcgcgatctggatccacgcggtgtcggtgggcgaaacccgcgccgcgcagccgctggtggcggccttgcgccggcagtggccggacgcgccgctgctgctgacccagatgaccccgaccggccgcgccacagccgaagcgctgtacccggacgccgaggtgcgctacctgccctacgattatccacaggccgccgccgacttcctcgccgcctaccggccgcgctgcggcgtgctgatggaaaccgagctgtggcccaacctgatccacgccgccgccgcccagcgggtgccgctggttttggccaacgccagactgtcggacaaatcgctgaaaggctatcgccgcatcctggggctgattcgcccagccatgcgggatttggctgctgttgccgcccaaacggcagctgatgccgatcgtttccggaagataggcgcggaaaacatcacggtttgcggcaacagcaaatatgatatagagattccggcagaacagatgcaactggcggatggcttccgccagcgcataggcgcgcgccaggcgctgctgtgcgccagcacccgcgaaggcgaggaggcgctgattctggacgcctggctcgcggccggcgacgcggtcggcgacgcgctgctggtgttggcgccgcgccacccggagcggctgcaggcggtggcggagctggcggccgagcgcggtctgaagctgcagcgccgcagcgacggcgccgcggtggcggcggacacccaggtgtggctgggcgacagcatgggcgagatgttcggctatcttggcgcttgcgacgtcgccttcatcggcggcagcctgctgcctttcggctgccataacctgatcgagccggcgatcgccggcgtgccggcgctgttcggcccgtcggtgttcaatttccagcaggccgccgccgacgcgcaggcggccggcgcggcgcgccaggtggccgacgccgccgaaatggtggcgctggcgctctcgctgctggccgaccccgagcggcgcgcggcgatgcgcgaaggcgcggcggcgttccgccaggcccatcgcggcgccagccagcgcatgctggaagtgatccgcgcgacgctggacgcgagctaaaccatccgcggcatcggcaaggcaaaagccgtccaccctcgcgggaagacggcttttttcatgcggggcggcgcttacggcgcggcgggcggcgtcagcgcgaaggcgaacaggtcgcggcggtaggtttccaccaccaggctgaacggcacattgccgtcgcggtacagcacggcaatgtgctggatcacctgttcggggatgtccagcgcgcgttgcgcggcggccggcgcctgcggccgcatttcccagcccggcgccagcggcgaccacagcactctggcctgctcggtgcggcgggtgaagtccagcgcccgcaccgccgcgccgaacggcgtgtcggtggtgtccagcaggcggttcatttccgggctgaggcgcgacggcacataccagttgtcggcttcggacagcacatggtcgccgcaggccagctgaacgcggcggtagcctatggtttcggcggcgcccacctgcagctggcggcggatgtcggcgtcggccggcttgcgcacgtcgcggtcgcgcagcgcgcggatgcgcggctcggcggccagccggtgatcggcgcaccattgctgcagcgtgcgggtggcgctgctgttgctcagcaaggtggcgttgacggtttgcagcagcgccagcgctttgacgcgggtgtcggcgtcgtcgcgccagcccggatagggccagccgtcggcgcgggcggcggcggagagaaccgccggcagcaacaggaccaggggccaaagcggggagaagccggcgcgcggccggcgaaaaccgtcatgattcatagttttatcgaacacttagcacaaagacattaaagaggcctggcgtaaacgcaaagttccccgccgcgacgctgaactcgggcggcttttccgctaacgtgaaagctgggctgtccgcaacgggctgggcagcctgcaccgccctgtattgccctgcgaggagccgccatggctaacgattttcaacccttgcccaccctgactctgccacgcaccaccgacctggtgcaactggagcagcgcccccaccccccgatccatgcgcacagcccggccctggccgtgatgaccgacctgcggctggtcaatccggtggggatttccgccgacgccggcctgcgcgaggcgcaccagcgcatgatcagccacggcatccgcctgttgttcgtccatgacggcgacggcagcctgctgggactggtgaccgcggtggacctgctgggcgaacggccgatccagtgcatgaaggagcatggcaagcaccacgccgatgtgctggtcggcgacgtgatgacgccgcgcgacaagctggacgcgttgcggctggacgacgtggcggcggccaatgtcggccagctggtggcgacgatgaagcagctgggccgccagcatgcgctggtggtggagcagaatccggccagcggccatcacgaagtgtgcggcctgttctccaccagccacatggcgcgcttgctgggcatgccgctgtcgttcatccgggtgccgcaggccttgtcggaaatccagtactcgctgctgtacaccggctgatttcggcaagaatcgggtcgccgccgcgctggcgctttcttagacttcgggcatgatagacagcgccgaaggagagaaagacatggactggcagatcgaaaccctggcgcccgccttcatccagcgggcgcggcgcgaaggcgtggacgcgctggggcagccggtgcggcgtctggccgcgcgaggaggcgaaccgctgcgcgacgcgctgcggcgcgcccgtccgggcgaggcgctgatcctggccagctacagtccattccggctggatggcccgtaccgcgagttcggcccggtattcctggcggccgagccgcaggcggaaagcctgccgtcgctggacgccttgctggccggacccggctatttccgcgacgcccccgcgctgcgcgcctacgacgccgggcaatcgatgctggaggcggcgttgccggcctgggaccaattggccgagcggctgcggcaatggcaggcgcgcgccgacatcgctttcgccatgctgcgctttcccgcccacggctgctacgcgctgcggctgaatcggggggaactgacatgagcgaaaccctgcttgccggcgccgaagccggccgcgactaccaccgcatggccgacgcgatccgctacctggtggcgcacgccggccaacagccgcggctggccgacctggccgccgcgctgcatctttccgaatcgcggctgcagcgcctgttcacgcagtgggccggcgtcagtcctaagcgcttcatccagcaactcacttgcgaggcggccaaggcgcggctggcggccggggtgccggtgctgccgctggcgcatgaactgggcctgtccggcggcagccgcctgcacgatctgttcgtcacgctggaggcgatgacgccgggcgaataccagcgcggcggcgccggcctggacataggctggagcgtggaggccagccgcttcggcccgctgctgctggcgcagaccgcgcgcggcgtctgcgcgctgcagttcgtcgccgacgaggccgcggccgaggcctggctgcatgggcaatggccgcaggcgcggctgcgctatcagcccggcgctgcgcgcgcgctggccgagcggttgttttcgccgctatcgccgcgcgcaggcccgccgctcgcgctgcgtgtgcagggcagcaatttccagatccaggtgtggcgcgcgctgctggccgtgccatacggcagcctggtcagctatggccagttggccgccggcatgggccggccgcaggcggcgcgggcggtcggcggcgcggtgggcgccaatccggtggcctggctgattccctgccaccgggtgatccgcgccgagggcgcgctgggccagtaccgctggggcgaaacgcgcaaggccgagctgctgggttgggaaagcgcgcaactggccgcgcggccggagccggcggcgtggttggcctgaggcgcgaagcggcctggctgacgctgctggccgccatctggggagcgtcctttctgttcatgcgcatcgccgcgccggtgttcggcccgctggcgctgatcgcgctgcgggtgggcctggctgcctgcgcgctgctgccgctgatggcctggcgcggccaattggcggtatggcgcgcgcattggccggacatcgcgctgaccggtatcttccttaccgcctttcccttctgcctgatcgcctgggcgcaattgtcgttgccggccggcatggcgtcggtgctgaacgccaccacgccgctgatgaccgcgctatgggcctggccgctagccggggaaaagctgacgccgccgcggctggccggcctggcgctgggtttggccggggtgctggtattgctgcgcggccgcggcgccggtttcgacgccgctgggccatggccggtgctggcgatgctgggcgccaccgccagctacggctgggcgggacagatggtgcggcgccggctgcccggcctgccgcccttggctaccgccggcggcgggttggccagcggcgccctgctgatgctgccgctggcggcgtgggcgtggccggccgggccgattccggtgcgcgcctggctggccttgctggcgctggcctggctatgcaccgcgctggcctacctgattttctaccggctgatcgccaggctgggcgccacccgcgccagcggcgtcacttacctggtgccggtgttcggcgtgctgtggggcgtgctgttcttgggcgaggcgctgagtccggccatgctgctggcggcggcgctgatcctgggcggggtgctgttgctggggcggcgctagtccggcgcggcggtgcgctacaaggccagcggtaccgatggcgatgttggcagcgcgccgccgcccgggccggccccttgcgtggcgggagcttttcagcggcacccggtagcgttggccagtgatggcctggcgatgtggctgccggacgggcggcgctgaacgggcggcgctgaacgggagctgcctcggggggagcggggaatatcgggaatcgagttgggatttctgctggcttaccgcgtggactatgcagcgctcagcgccaatgtgctgagcaccgccttgctccgctgggctggcggctgtttcgcgaacagccttcgctgggcgggctggggcttagcctggccggcctgtggatgatgctgcgattccgctgaggcggaccgggccgcgggcccggcccgatttcaggcctgcggcaggtggatcgccaccttgaagccgccgtcctcgtcggccagctccagccggccgccgtgctgcttgacgatgcgggagacgatggcgaggccgaggccgctgccgccgtcggtgccgcggtgctcggccaggcgctcgaacggcgccagcgcggtttcgcgcagcgcctcgggaatgccctggccgtgatctatcacgctcagcaccacttcgccgtcgccttgctccaccctgaccaccaccggcggctggccgtagcggcgcgcgttttccagcagattgctcagcaggcgctccagcgccagcgcgtcggcttgcagctcaggctcgctgcgcgcctccagcttcacgtccatgtcctcgcggcggaagcgcgccaccacgctggcggccaggtcggccagcgccagcggttcctggcggctggtttcctcggcgcgggcgaagtcgatgaactggcgcacgatgcgcgacaattcgtcgatgtccagcagcatgtcgtgctggtcgtggctggtttcctgcatttccagcgtcagtttcagccgggtcagcggcgtgcgcaggtcgtgcgacaggccggccagcatcagccgccgctcgcgcgcggcgttgtccagcgcctgggccatgccgttgaagttgtgcgccaacagctgcacttcgcgcgggccggtttccggaatggcttgcggcatcgagccgccggccagctcgcggctggccatcaccacccggctgatcggccgcgtgatgcgccaggcgaacagcgaggccaggacggtggcgaacagcgccgccagcagcgacgcctgcagcatcgggttgatccagcggtcgcggtagcggccgaacggaatcaccagccagtacggctggtccagcacgtgcacgtgcacccacaattcgctgtggtcctcgcgccgcgcgtaatgcgcctggataggctcgttcaggtcgtgcgacagccgctgcgccagcatcgcgccgatcttgggcaggtcgtcggcgaagttctggccgtggtcggcgttgaacggcagcaggctgggcaggccgggacggttgtaattgtccagaaaggcctgcctctcctcgttgctcatgccggtcatcgagtcttccagataggacagcgtgtccagcacctggatgtacagctggcgctccagcagcttgtgccgctcgtggttggccagcgagatggtgaacagctgggtggcgatcaccaccgccaccatcagcagcgccagccggaagaacagcgaaccgaacagcttgcgtaacaaggcttactccctgggcgagccgtccggcacgaacacgtagccgtagccccacaccgtctggatgtagcgcagctggctgtcgccgttttccagcgccttgcgcaggcgcgagatgtgcacgtcgatgctgcggtccagcgattcgccgttgcccttgcccagcgccagctccatcagttgttcgcgggtgagcgggcggcgcgggtggttgaccagcaccgacagcaccgcgaattcggcgctggtcagcgcgatggcctggccgctgcggcgcagttcgcgctggccgaggttgagcaggaattcgccgaactccaccacgtcgtcggcgttgtgctgggcggccagcgccggggtggtgtgatggcggcgcagcaccgactggatgcgcgcggtcagctcgcgcgggttgaacggcttgggcaggtagtcgtcggcgcccatttccaggccgaggatgcggtcgatgtcttcgccgcgggcggtcagcatgatgaccggcagcgattcgccctgggcgcgcaggcggcgcaccaccgccaggccgtcttcgcccggcatcatcacgtccagcacgatcaggtcggggcggttgcgcgccagcttgcggtccaggtccttgggatcgggcagggtttccacgctgtaaccctgttgggtcagataacgggtcagcagctcgcgcagcttggcatcgtcgtccacgaccaggattttattgtgttccatgtggttttcctcagtgttcaggctgccagcttagcggcgcgcgccctgctgctggcaggccttgtttttacagatgttaagcccgtccgtcgcgatacagtcgttaacaattgtgcggccggcgaagacgtctgagcaaacgcttggccctaagctgggacaaggggaaagcctgatccggctcccggaacgcaatcgccagcgtaatcaagcatttggcagctccgcggcgttccggccgcgcggccgctttgcggcggttggcgcttgcggtcccgcccgcggacggacgcggccagccaggccatcccgagtggtcatggcagcggttgtcatagacaggataaaatgccgacatgaagcgatatctgatcattctgctgtggggcagcctgtttgcgcaacaggcggcgctggcgcagggtttccatccgcgcggcccggcccgcagcgccgagggccggccggcgtcttgccaggccgatccgcaatgcccggaaaaccgccgcctgcgcaatctgcgccagcgcgaggcggcgaagaatggcgatatggcgttcgatccgatcaagcaccaatccaaccgcctgctgccgcccgctgcggatggccacgcgcaagcggttcccgccaagccgaatttttggcaggataagcgtagacaggaacaacagcagaaccagtccgaatgattcgtcgtccgctcgggaaaggacgcagtgatgaaaccacaggggatgtctggatggggtcggcgcgtctgcgccggggtcggcctgctgctgttctgcctgcaggctcgggcggcggccgatgaggattgcggccgcgccgtcgcgccgcagcgctgcttgctccatcagcagggcctgcgcagttgtcttgacctggccgagtcgcgccgccgcgcctgcctctcctactatacccccccattgagctgccagcgccagcgcgacgccaagcgctgcgaggcgttgctggcggcgcaggcctcctgcgaaggcatgactggcgcctcccggcgccagtgcatagacgagaggctgccggccggagactgcccgcgttcggcccagccctgcccgaaaccgctgccgctcgccgattgatcagggcaacaggatgatggagccggtggtgcggcgctgctccagatcgcggtgggcctgggcggcttcggccagcggatagcggtgcgacggcgccagccggatccggccgtccagcagccgctcgaacagcgcctggctggactgttccaattccgcgcgagtggcggtgtagtctcccagcttgggacgggtgaggaacaaggagccgtgcttggtcaattccagcggcgacaccgccggcaccgggcccgacgcgttgccgaagctgaccagcatgccgcgcggcgccaggcaggccagcgaaatctgaaaggtgtccttgcccaccgaatcgtacgcgaccggcacgccctggccggaggtgagctcgcgcacccgcgccaccacgtcttccgcgcggtagtcgatcacatgggcggcgcccagccggcgggcgatttccgccttggccggcgagccgacggtggcgatcacgttcacccccatcgccgtcagccattgcagcgcgatctggccgacgccgccagcggcggcatgccacagcacggtctgccccgcttgcaccgggtaggtgcgctgcaccagatactccacggtcatgccctgcagcattgcgcaggcggcggtttcgtccgccacgccgtcgggcagtttcagcaggtgctgcgccgcgatcagccgctcagcggcgtaagcgcccaacgggccgccggcataggcgacgcggtcgcccggcgccagccagtccaccccggcgcccaccgcctccaccacgccggcggcttcgctgccgaggccgctgggcaaaggcagcgggtagaggccgctgcgctggtaggtgtcgatgaaattgacgccgatggcggtatggcgcaagcggacttcgccggccgcgggcgcgccaatcgacgtttcgaccaggcgcagcacgtccgggccgccggttgcggaaaacacgatgctgtggctcatggggcgctccttgcaagtatggcggatcagtctgcgccggcgccgcagcggcggcaagtggcgataggcgaacgggccgtcaagccgggatggacaattgccggcgcgcccaggcgacgatttccggcaataccttcggccagttgttcagacggtggtcgtcgccattgaatacagtttgccggctgtggcgataatgcgccgcggcttcgcgccaatccagcacctcatcgcggctgcccagcagcagccagtagcgcgccgggctgggtttttccacccgctgcgcctgcagcgcggccaggtcggcgtctcccagcgtgtaaacctcgccggtgtacgggttggtctgctcgccggcgaaacgtgccagatcgcggtccggccgcaccgccggattgatcagcgccgccggacgattttgctgttcggccaggaagccggcgtagaagccgccgagcgagctgccgatcaagagcgtgtccgccggcagcgaggccagcagttcgccggcctggcggatggcctcggccggatgcggcgacagccgcgggcagtggaacgtgatgtcgggcgcgtgtcgggccagccaggcggcggtttcgccggccttgagcgattgcgggctggaattgaagccgtgcagatagacgatgtgcatgaagtttgccgccgatgtgatggtctggatgttacgacgcggaatcgcgcttgtcagttgccgccgacggtcgaccggcgtgtaaatttggagtaaaagcacttttcgcgcgatgccggccattgtcatccggccgcggcggatgctcaaataagcgacaaatataaatatcgaggagaaaacgacatgaccaccctgcccgccgccgcgccgacagccgccccgcattcgctggaaagcctgatcgtggcctgcggctatctgcagcacagcgccctgctgttcgcgcaggatctggacagcgacctggcgctgatccgctccggcttctgtccgcgccatcaggtgcaatggaacgcccagggcgaaatgcgggcgtgcgccgaagttcacgacgaagtggacgctctgctgcaaggcagccataccttgcgtttcgcgctgcacgaaatgctgatgcagttcggtccggaagtttgcaacgaggcgttggcccgcatcatcctgcaaggcgtgcgcagcctgcccgactggcaccaggtgtgccagtcgctggcggacttggggcgcggcccggtgcgcgtggccgcctgaggcgccggttggccggggcccgccgcaagcgggcgggttccggttgtgtccgagcggcggcggagataggctcggagggcgatgccggaattgcttgcaaataaatagcgcgctatttattatcgagggcatggaaagcaaaccgacccttccctccgacgccgacgcgctgcggctggaccagcaattgtgcttcgccctgtattccgcctcgctggcgatgaacaaggcctaccgcgacagcctgaaaccgcttggcctcacctattcgcagtatctggtgttgctggtgttgtgggagcaggaccagcgttcagtgtccgacatcggcgcccggctctacctggattcggcgacgctgacgccgcttttgaagcggatggaggcggcgggctggctgctgcgcgaacggctgtccagcgacgagcgggtggtggtggtgaggctgagcgaggccgggcgcgatctgcgacgccaggcggaagcgattccgcggcagatgctatgccgcagcggactgccgctgccggaggcgcggcagttgcgcgcggcgctgggcgcgttgcgcgaccagttgctgccatgaaaccggcaggttttatgatttgaatagtgcacgatttaatagcttattatttttccacgggaagactgtaaggagacgtacgatgaataccctgcaaaaagtgctgtataccgccgaagccaccgcgttcggcggccgcgatggccgcgccgagtccagcgaccaggcgctgcaagtgcagttgagcacgccgcgcgaactgggcggcctgggcggcgacggcaccaaccccgagcagctgttcgccgccggttattccgcctgcttcatcggcgcgctgaaggtggcggcgatgcaggccaaggtaggcttgccggccgaggtgtcggtcaagggacgggtctccatcggaccgatcgagcacggcttcggcatcgcggcgcggctggaggtttcgctgccggggctggagcgcgcgacggcggaagcgctggtgcaggcggcccaccgcatctgcccgtattccaacgccacgcgcggcaatatcgaagtggagctggcgctggcgtgagcgaagcggccgtcaggcgacggtttcggactggtggctgggcgactgcttgttgccgtacatcttgcggtcggccaccgccagcaattcgtctatcagcaggccgtcctccggatagtaggcgatgcctatgctcactcccaccatgatgcggtgctggtccacctggtagggcagctggatcgcctgcttcagcctggccatcaccttgtcggcctcgcggttggactcgatgtcttccatcaggatgacgaattcgtcgccgcccagccgggcgacggtatcctcgttgcggatcacgtcctgaatgcgggcggcgatcagctgcagcacccggtcgccggcgacgtggccgtaggtgtcgttgaccggcttgaagcggtctaggtcgaggaatagcaaggccaggcgtttgccgctgcggtcgacgcggctgatcgcgtgctgcagccggtcgtagaacaggttgcggttggccaggccggtcagccggtcgtgattggccagatggaacagatggttttcgcgctggcggcggctgttgctgctgcgcacgaagctgtagccggccagcgcgaggccggtgcccagcagcagcgacagcagcagccacaccacccactccagcaggccgatctgcggccagccctgctgccagttgatggtgaaacgcagcggctggccggggccgcccagcaactgactggtttccagccgcggaaacagcaggcgctccagcgcgccggcgcgggcgctgcccagcagcagaggctgtccgcccggcggccgcagcgggtcgtcgcgctgctgcacgctgatctccatgcccggcggcagcggcgcgccgctgggcagcagcgagtcggcgcggatgaacagcagggcgaaatgctgcggctgcagctccagcagcgcgccggactggtggttgtctatgctgcgcagcagcgcgtagccggcctcgccgttcggcaggcgcagctggcgcgacagcgtggtgcggccgctgttgaggctgtcctgcagcgtttggcgcaacagcggctgttgccatatgtccatgcccgccagccgcagattggcctgcgattgcggttcggcgaacatcagcgggaagtagtcgtcctgcagcggcagcggcagcggctggccggcggcgtccggcgcataggggcgcagccggtagccggcgccgtactcgcgttgcagccagcggttgtagctgtccacccgcgagcgcggcacgcgttcgatatgggccagggtgatgatctgcggatagcggcgcagcagttgcagcacgaaggggtgtttgcggcgggtttcgttgcgatggtcgagagcgctgaaggtggcgtagctgtcgagcacggtttcattggtgagcaggcgttgtttcaactgctcggacaattgctgggactggctgttgaattgctgttccgcgcccagcagcgagcggctggcaatcgacagggccgccagcgagctcagtatcaaccacaaggttatgcatccagcataaaccagtcttgcttgcatgttaaaaccatcgacatatattcggcaatggatgattctataagaatgggcccctattttttagcaataaatcagggaaagccggatttaagtaatagtacgtaacagtggcgcggcgctcagcgcggacttgatggcgggaatctggcggcggctcaccggcagcggatcggccacgtcgcgcagccgaatcacccactgttcgtcgccgtccaggccgctgcggcgcagctcctggaccgcgtggcgcatcaccaggcaattgcggtgtatccgcagcgccaggccgcccagccgctgctccagcgtcaccagcgcttcgtccagcaggtattcgttgtcgggggtgaccagggtgacgtatttgagctcggccttcaggtagcgcgcgtcggcgaagggcacggtcagcagccggccgcgctggcgcacggtgaagctaggcgcctcggcctggccgccgcagcgcgccagcgctttttgcagcgcctgttccagccgttcgcgccgcaccggcttgagcaggtagtcggcggcgttcagctcgaaggcctccaccgcgaagtggtcgtgcgcggtgctgaacaccagctgcggctgcagcggccgctgcctgagctggcgcgccaccgccatgccgtccaggcctggcatgctgacgtccagcagcagcacgtcggccggatgctgggccagccaggcgagggcggactggccgtcggccaggcaatgcacctggctgacgccgcaatcggccagcagctggcgcagccgttcgcgcgccagcgcctcatcgtccaccaccaccacccgcagctcgctcagagcgcccattgcggcttgtccatcttgtccaccagctggcgccaggattgcaggatcttctggaacttgttgttggtcggcgcgatgtcgcgcaccttgcccaatagctcgtaggcgcggcgcatatggctttcatgccagccgttctggctgacgtgggccagcaccgcgttgaccaggttgagcatgatctgcacgttttgcggcatttcctccagcgctttggcgaagcgggcgatggcggtgtccagctcgccgctttgcgcttcgcgcaccgcctggttgttcagctccagcaccgtcttcacgttctgcgcgatcagctggcggccggcctggcccatgcccagctcttcgaacatgtcgccgaagtgggccagcagctgttcatcgtcgtggtggttgcgcaccaggtattccatcacttcgttgccctgcggctcgcggccctgctggtagcaggcgcgggcgtattccagctgcgcttcctggtccagcttggccgccagcggcttgaagcgctcggtggcgtcggccagcagtgcggcggccttgtcggcgttgccgttcttggcctgcaactggctgtccaccacattggccagccactccgcctcttcgttgtagcggtagtcgtggcgcaggctggccagcgtgcggccggcgttggcggcatcgccgcgcgccagctggatgcgggccagcgccgcgtaatgggtggggctgcggtgccaggtgtacttggcgatgtccagcgtctgctggcaggcggcctcggcggtggccaggtcgtggttgagcatcgccacttcggccagctgctgctggcggcggaacaccgccggcgacatttcggcggcggtctgcagcgtgtgctgcgcgcgttccagatcgtggtggttgcggtagagccgggccagccagtcgtaggcctccatcacttggctgttgtcggccagcaccgcctcgaacagcagccgcgcctcgtccagcgatttgagtccggccagcgatttggccaggcccatcttggcccaggtggccggtttgaggcgcagcacctgcatataggcgtcgcgggcggcgtcgtaatcctcgattttcagcgccagcgagcccttgaggcgcatgaagtcgaacgcgaactcgccgttttcctctatcttgcggccgcaggcttcgatggctgccagatactcgtgacgcaggatgttttcgtccaccagccggaacgcctcgcgcttgcgcatcgcccgctccaaccgctcgcgcagcacctcaccggtgaagggtttgagcaggtagtcgtccggggccatctcggcagcggaaatcacccgctgcgagcggcgctcgccggtgacgatcatgaacacgcaggattgcttgagcagattgcgcgcccggacttcctcgaacaggtagagcccgtcgtagccgttgcccagatcgtagtcgcacagcaccacgtcgaactcgtacttggccatcttggccagtgcgtcgccggccttggccgcgtattcgaccgagttggcgccgaacgacgacagcgtcatcgccagcgcccgctgcatctgcggcaggctgtctatgatcaggaacagccgtttggcgtagggatcgtcgtaagcgttgcgctggggggcggcccgcacatggtgcgtcgggccgttcggcgcggccggagggggagtggattcgctcatggggctttcgtcagcttgcggcatgatcctgtttcggtcggatggcgtctccggcggcatgctccctcccggcgccgggcgcggctcaggccggcgtcagttttgcataacgcagatccagccatttcaccccgtgttcggcgaagttgatttgcaagcgcacgtcctccccgctgccctccgcctggatcaccacgccgacgccgaatttggcgtggctgaccgactggccgatgttcaggccgtaggcgttcgcggcctgcaggcgcggcgtcctggaggcggcgcgcgccggcatgggagacgcgggtgttttcactgtagcagacagcgagtggatcagttccgccggaatctcgtcgatgaagcgcgacgggatcgggtagcggctctggccgtgcagcatgcggctttgcgcgctggacaggtacaggcgcttgcgggcgcgggtgaccgccacgtacatcagccggcgctcctcctgcaggcccttgccgtcctgcaggctgttttcgtgcgggaataggccttcttccaggccggtgacgaacaccgcgtcgaactccagccccttggcggcgtgcaccgtcatcagctgcagcgcctcgctgccggcgtcggcctggtgctcgcccgcttccaggctggcggcggtgaggaattcggtcagcgcctggctggggtcgtccggcaggaagctggcggcggcgttgaccagctcgtccaggttggccagccgctcctcgccgtccttcttgtcctgctcgtacatgtcgcgcaggccgctgcggtcgatgaccaggctgatggtttcggccaggctgaagtcgcggctctgttcgcgcaggcgttcgatcagcagcacgaactcgcctaccttggcggcggtgcggccgccgccgctctggcaggcggcctgccacagcgacacgccctgctcgcggccgacggcctgcaggccttccacgctgcgcgcgccgatgccgcgcgccggcgtgttgatcacgcgcagcaaggcgttgtcgtcgtcggggttggccaccagcctgaggtaggccagcgcgtgcttgatttcctggcgttcgaagaagcgcaggccgccgtagatccggtacgggatctgggcgttgaccagcacgtgctccatcagccgcgattgggcgttggagcggtacagcaccgccacgtcggacagcggcaggccgtcgcggcgcagcgccttgacttcgtcgacgatgaactcggcttcctcgccgtcgctcatcgcctggaagaagcggatcttttcgccttcgccggcgtcggtccacaggtttttgcccagccggccgtcgttcttttcgatcagcgcgttggcggcgttgaggatggtgcccatcgagcggtagttctgctccagccgcaccggctcggccacgtggaagtcggccagcagcgcgcgcatattgccgacttcggcgccgcggaaggcgtagatgctctggtcgtcgtcgccgacggcgaacagcgcgccgtgctcgccggccagcagtttcagccacgcgtattgcaggcggttggtgtcctggaattcgtctaccaggatgtgggcgaagcggctgctgtaatgggcgcgcagcgcctcgttgcgcgacagcagttcgtagcttctgagcagcagctcggcgaagtccaccaccccttcgcgccggcattgggcgtcgtaggcggcgtacagctccaccagcttggcttcgtacgggttcagcgccggcggcagcgcctcggcgcgcacgccggcttccttgttgccgttgatgaacgactgcaccgcgcgcggcgggtatttctcgtcggacagctccaggcttttcagcaggcgcttgatcgcggcctgctggtcggcggagtcgaggatctggaaggtttgcggcaggccggcgtcgcggtagtggatgcgcagcaggcggttgcacaggccgtggaaagtgcctatccacatcgtgcgcacattcaccggcacctgggccgacagccgggtctgcatttcgcgcgcggccttgttggtgaaagtcaccgccagaatgccggccggcgaggtctgagcggtggacaacagccaggcgatgcgggtggtcagcacccgggtcttgccgctgccggcgccggccagcaccagcgcgctcttggcgggccaggtgaccgcgcgcagttgttcgggattcaggccggctaacagatcgctcatgacgggacgttttcgctgcaaaaacgccattttagcatgcgtgccgccaggacaaggcggaggggcttactcctgtgcctggtaatgcgcaagcatggtcttgagcttgccgttcttgtgcaatcgatccacggcgcggttgagttcggccagcttgaccggcgactgcgacgacagcgcgcacatggtcggctgcgacgataccactagcgggtgcagcttgaaggcggcggcttcctgcgcatgggagcgcgcccaccagacatagatgaactcagtgacgatggcgacatcgctcagccgtttttccagcgatttgaacatcagatcgaagcgggcctcggtgtcccgcgtgctgcggttgctagaccacaggtattccagctcggggtaatggtagccgtgctgggtgccgatgcgcttgccggacaaatcgtcgagctggcggatggccggcatgtttttcagcgacagcacgcgctcggtcagcgggtaaatttcccggctccagttcagccgggaagaattgctataccagtcgggattggcattgcagacgatgtcgaccttgccggtttcaaccgcggactccacccggcggcgcgccagaatgacgaactgcggcttcatccccatttcttcggccagcagcatccccagttcgcgcgccaggccgccggtcagggtattgccgtcttcggatagcaccgcgatgggggcggcatcggtatcggccaccccgatgcgcagctcggcggccgccagcgaaggaagcggcgccaacagcaacaggcagggaagcagccactttttatgcaaactggccatatagatgctctctcttaattctattaccgggtgtctgatgcgcgggatgcggatgttaagatgaatcaggaatacgccgtagccttgatatcgttttagacaaaataactgcaagcgacatgacgaagccattaacccatcccgtttatcagcacctcgcccaacgcattctgatcctggatgggggcatgggcaccatgatccagcgccaccggctggaggaggccgattatcgcggcgagcgtttcgccgactggccttgcgatgtcaaaggcaacaacgacctgctggcgctgactcgtcccgatgtcatcggcggcatccaccaggcttacctggacgtcggcgccgacatcatcgaaaccaacaccttcaacgccacctcgatcgcgatggccgattaccggatggaagggctggtgtgggagatcaaccaggccgccgccaagctggttaaggatctttgcgcggcgcaaaccgccaaaaatccggccaagccgcgtttctgcgccggcgtgctcggccccaccaaccgcacctgttccatcagcccggacgtcaacgatcccggctaccgcaacgtcagcttcgacgaactggtggcgagctacaccgaggcgatagacggcctggtggccggcggcgcggatttgctgttggtggagaccatcttcgacacgctgaacgccaaggcggcggtgttcgccatccaccagtatttcgacgagcgcccggacacgccgcgcttgcccatcatgatttccggcaccatcaccgatcagtccggccgcacgctgaccggacagaccaccgaagctttctacaactcgctgtcgcacgccgacgccgccagcttcggcctcaactgcgcgctggggccggacctgctgcggccgtatgtcgaggaaatggcgcgggtgtcggccacctatgtctcggtccacgccaacgccggcctgcccaacgccttcggcggctatgatctcgaacctgagaagatgggcgagtacgtgcgcgagtgggccgagagcgggctgatcaacatcgtcggcggctgttgcggcaccacgccggagcacatcgccgccatcgcccgcgcggtggacggcatctcgccgcgcgcgctgccgcggatcgaggccaagtgccggctgtccggcctggagccgttcaatatcggcgacgaagacctgttcgtgaacgtcggcgagcgcaccaacgtcaccggcagccgcgccttcgccaagctgatcctcaacggcgactacgccaccgcgctggacgtggcccggcagcaggtggagaacggcgcccaggtgatcgacatcaatatggacgagggcatgctggacgcccacgccgcgatggtgcgcttcctgaatctgatcgcgtcggagccggatatcgcccgcgtaccgatcatgatcgactcgtccaaatgggaggtgatcgaggccggcctgaagtgcatccagggcaagggcatcgtcaactcgatctcgatgaaggaaggcaaggagaagttcgtcgagcaggcgcgcttgatccgccgttacggcgcggcggtgatcgtgatggccttcgacgagcatggccaggccgacacctacgcccgcaagatcgagatttgcgaccacagctaccgcatcctggtggacgaggtgggcttcccgccggaagacatcatcttcgacccgaacatcttcgccgtcgccaccggcatcgaggagcacgcccgctacggcctggatttcatcgaggccaccggctggatcaagcagcacctgccgcacgccaagatatccggcggcgtgtccaacgtcagcttcagtttccgcggcaacaacaaggtgcgcgaggcgatccacgcggtgttcctctaccatgcgatccagcgcggcatgaccatgggcatcgtcaatgccggcgcgctggaggtgtacgacgaggtcgacgcaagcttgcgcgagcgcatcgaggacgtggtgctgatgcgccatcccaaggacggcggcgacgccaccgaacggctgatcgagctggcggagaaattcaagggcgaggcggtcggcgagaaaaagggcgaagacctggcctggcgcgcctttccggtggaaaagcggcttgagcacgcgctggtcaagggcatcaccaccttcatcgtcgaggacaccgaagaggtgcggctgaagtgcgcgcggccgatccacgtgatcgaaggcccgctgatggatggcatgaacgtggtgggcgacctgttcggcgccggcaagatgttcctgccgcaggtggtgaagtcggcgcgggtgatgaaggctgccgtcgcccacctggagccgttcatcgaggaagagaaaatccgtctgggcctggccgacgcgccggccaagggcgtcatcatcatggccacggtcaagggcgatgtgcacgacatcggcaagaacatcgtcggcgtggtgctgcgctgcaataactacaaggtgatcgatctgggcgtgatggtgccgtgccagaccatcctcgacgccgcgcgcgagcaccaggccgacatcatcggcctgtccggcctgatcactcccagcctggaggagatgagccatgtcgccaaggagatgcagcgccagggcttcgacattccgctgctgatcggcggcgccaccacctccaaggtgcacaccgcggtcaagatcgcgccgcactaccagcacccggtcatctatgttcccgatgccagccgcgccgtcggcgtctgctccaatctgctgtccgataccttgaaggacgccttcgtcgccgagaacctggccgagcaagaacgcgcgcgcgaaggccacgccaacaaggccaatcgcaaggtggtttccctggagcaggcccgcgccaacaaagagaaaatcgactgggccgattatgttccgcccaagccgcgatggcttggcgtgcgccgtttcgagaattacccgctggccgagatcgccgcctatatcgactggacgccgttcttccagagctgggagctggccggccgcttcccgcgcattctgaatgacgagatcgtcggcgaatcggcgcgcgcgctgtatgaagacgcccaagtcatgctgaagcggatcgtcgacgagaactggctggccgccaacgcggtgatcggcttgttcccggccaatagcgtcaatcacgacgacatcgacatccgttccgccgacggccggccgctgatgacttgggtcggcctgcgccagcaattgcccaaaaccgacggcaaggccaactgggcgctggccgactacgtcgcgccccagggcagcggcgtcgacgactacatcggcgccttcgccgtcaccgccggcatcggcatcgagccgcatgtgaagcgcttcgaggatgccaacgacgactactcggccatcttgctcaaagcgctggccgaccgcctggccgaggccttcgccgagctgatgcacgcccgcgtgcggcgcgagttctggggctatgccgccgacgagcatatcgacaacgaaggcctgatcgatgagctgtaccgcggcatccgcccggcgcccggttatccggcctgcccggaccacacggtgaaggccgatctcttcaagcttttggacgcgccgtctatcggcatgacgctgaccgagggctacgcgatgctgcccaccgccgcggtgtccggtttctacttcagccatccggcgtcgcgctatttcggcgtcggcaaggtggaaaaggaccaggtgaccagttacgccgagcgccgcggcgtcagcatcgagcaggccgaacgcgacttggcgcccaatctggggtatgacgcctaagccgcgccgcttacgggttgggttcttgctggccgcgctgctggccgccggcttgtcgtggcggcagtcccggctgcccgccgactgcttctggctgagccgcgcagcctgtctggcgcgccttggcgccggcatggacaagcagattagcgaggtttggagcagcggccagcggcatggcagcgcgcagttgctgctggcgcgcgacggccgctaccagatttattcgctgcgggacgatgtcgacggcggcatcgatgtggctgaggctggtcgctggcaagaagtgaacgccgaactgacgctgaggccgctgctgggcggcgcaggcgcggcgcgctgcgcatcggcagtgccaccaggggcgctattatctggctcaattcccccatccgacggacatggcgcgccaaatgcgggcctggggtgaggatcgctcgggtttgcccccggctccgcccagtgcgaagccggacgcaacagcgctgtggcagggcggccagaccagcgcttgtccgatatgactcaggctgccgcgctatttttcttgctgtgttctctccgtcctattgaaatcgaaagccatttgaatgtcgggaccaaaaggcattttgccgaaggcggctgtcgccgccttgctcttcgttgtttgctgcgcgctgtgtgcctgccggccgaatgcgcaagtccgcagggatagcgtcaatcgtgaagctgaagaactgagccgcaaactaccagaagagggcagccaaatctggctgtactacggtttgacggtgatacagcagcggctgacgctggccgccaatggctattacgcttgggagtcggcgtccgatgacggcggcgcgccgccgccggatcgcgattatggccgttggcgcgaggaaaaggatcaattggtattggtttcgcaatttgacggcggcgaaacgcgtttgcaggcggggtgccgcgatggcgagtttgtctggctatatggttatgccgacgaggaacccgcctggcatggcaatggcgaacactcctgttcggaaatccagcatcccgctaaatccgataaacccttggcattccgatgaacgccattgagccgggcaggcgttcgctgtattggaagacattgcgatattggagaaaaccgcatgaagcaacggatttggctggtttggctgctgggcctgccatgggcggcgcaggcggcggtgcagagcgatacgcgctgttttgtcgccgccaacggcggcaagcccatccacctgcaattcacgacggtgggcgacgccgatgccgactggacggcggcttatgtgcgctatggcaagcgcggcaaagcgattaccttggtatggctgcgcaccgagcaagaagaaatggctgaggggcggccctatcaatttaccgacgaatggctggaaatcgtcgatggccgcatcaacggccgttacacgactatccatcagggcgccaattattacggctttcattaccgcggcgccaatggccgcgacatcgatttcgacgaggatctgggcgcgcgcgccgcatcgcaacacgcatgcaagtattagcgcaggcgccgggatgtggataactgcgaaagccgctggcggctgtggataagcggcgggcaagacccggcgccggcgccgggccctgcgctgttacggcttgggttttacgcgtttttcggcggctttgcgaaccttgtcgccgtcgaacagcacggcgccctgcttgcggccttcggcgctgaacgtcacccgcagttggccgttttccagcttggcggtggcattcgtgccggggttgaagtcgcccagatcatatttcttgacgctgccgccgcagtcgctgctgaccagcaccacgtcgcggtcttgcagcgcatagctgctgccgccttgcaggtagacggagttgtcggagtcggagtagatggttttcttgcccaggcgcagctcgatccggtcttcgtcggacaccacgccgtagcgggttttgatggtttcggctccggcttggtggcagacggccaacaggcccagcagcagggagagcagagtctttttcatggcggcttcgcaaatgaggatatggccgcgattttgccatgcggcgccctgccatccaatttacctattcacattgccggataaatgcttttgagttatcggctcagctgatcggctccaggtagtccagatgcgggatgcgcagcgccatctcgcggcggatgcggtcgcgcagcgcttgcagttgctcccgcttgtcgccgctgaacaagccgggcgcggtccagaaaacatcgaaacggacttcccggctggagacgaagtggtaatacagctgggtgcgcggctcgccgcctatgtattcgccgtcgctcgccgccgggtcgcagcgcaggcattgcagctggaacgcttgcgccgccgcgttgaacgcctctatcgccttggcgcggtcaagatcggcggattcggcgcggctgcggatgccgtatttctgattcagttgcggcgccgatgtcgcgacgcaggcgagcaaagcggccagcgccaaaggcggggtcagccagcgccgcgccgccggcgcggacagtgccagccgctcgcggcgctcgaaggccagccggcacagcggcagcaccgccagcgccagcaggtcgccgtaatcgacggtgcgggacagggcaaagggcagccacgcgttgacggcggcgatggcggggccggacagcgggcttttccaccacagccaggccagcgcgatggcggcgctggtcgcggcgaagcggcgcggccacagcgcctgggccagcaggcccgccagcgccagcccggcgaagtcggacagcttgccgctgagctagcccggatgggcggacttcagccaccagtcgttggccagcagcaggcatagggcgatcaggaaaggccagccggctatcacggcggagattcgtcgaagcattggaaaatccagatgggagaggcggcggcgatagagccagcttggctgcggccgacgctcagttgatcggttccaggtagtccaggccggggatgcgctgcgccatctggtagcggatgctgtcgcgcatcgcttccagccgctcgcgctcgccgccgttgaatacgcagggcaacacggtccagatgtcgaaacgcacttcctggttcgaagaaaactggtagcgcagcagcacgctgtgtttgccgccgccttcgtaaacgcccttgtccagcgctggatcgcagctttcgcagcgcaactggtattgcgccgccaccgcgttcagcgcttccacgaccttgacgcggtccatccgcgcggcgctggcgcggctgcgcacgccgtactgctggctgtacggcacggcggacgcggcgcaggccagcacggcggccaacgccaggggcggcgccagccagcgccgcgccgccggcgcggacagtgccagcctcttgcgccggacgacggccagtcggcatagcggcagcaccgccagcgccaagaggtcgctgtagtcgacggtgcggccgatgcggtacggcgccagcgcgttgaaagtctcgatcgcggagctggagcaggcgcttttccaccagagccaggctgccgccaggccggcgcagatctcgccgaaacggcgcggccaggccgccagcagcacgatgccggccagcgccagcccggcgaagtcggacagcttgccgctgagccagcccggatgggcggctttcagccaccagtcgttggccagcagcaggcatagggcgatcaggaagggccagccggagacggcggcggcgaggcgtttgcgcatggaacaggccggggaaggtggtgggcgcgacattttaacagccgcgcggcccggcggtccggaacccgctacactcagggtgcgggccggcgtcgcccggcgccgggccgttttgggggagggcgaatcatggaatggctgaaccgcgaaagcctgcttggcctgatggaggatgtggaggcggaggacccgatagactacgccgatctgccgttcgacgaacgcaatctgcgcgaattgatcgtcgattcgttgctggagcgcgagttggtgttccgcgccgaggagccggacgcctcgcggcggatgctggtgtatctggcggctaccgcgcggttgacgctggagaacatggtgctgcatgcgcgcctgctgcgcgccggccgcgccgaagactgaaacctgcgccgccattccagattcacggtccaattcaatggcttatgacgtatgacgtttgagattgttatggtccgcatggtctattccgcgtagaatccagcgcttgcgcggcgcagcagctttagtcgccgacgctgttttcccggcatataaaccataaagaatcgtgatgaaaaaaatactcgcgctgtccgcttgcgcgctggccctgagcggctgcagcgccatgaccaccatgagcagctccgcgcccaagggcgcggtttccatctatcagcgccagcaagtgaccacgctggatttgcccaagaccgaaacctatcccaccaccagcttcggcaactatgaattcaaggccaccggcgaaggcaagcagccgctgtacggcttgctgccgttgaagttcaacggcggctatgtggccgccgacatcctgttcttcgctccggcgctgttcttcaacctgcgcgaagtctacccgctgtacgatttcgacttggacaagggcgtggtgcgctaccgcctgaaggacaccgacaactggaccgagtacaagccgacgcagccggaagccgaacgcgcccgcagccatatcgacttcgccgcctcccagccggcggccgaggccgcgccggtcaagaccggcagcaactgattcgcctggccggcggacgttcccgcggaacggaccgccggcggttttctcctttcccttcctctccccgtctttcgacatctcccgatacacatatggcatagcgtcgattacactggcgcattcccaccctcccgagcaaaggcattgccatgctgcgtattctcggccgtaccagttccatcaatgtgcgcaaggtgttgtggacctgccacgagatcggcatcgactaccaacgcgaagactggggccgcggctttcagcccaccagcagcccggaattcctggcgctcaatccgcatgggttgatcccggtggtggtggacggcgataccgtgctgagcgaatccaacaccatctgccgctacctggccgccaagcacggccgccacgacctgttgccgcaaaacccggccgcgcgcgcccaggtggagcggtggatggactggcaggccgccgatctgaaccccgcctggatatacgccttccacgccctcagccgcaacagccccgaccaccaggatccggcgagcatcgccgccagcgtggcggcgtggaaaaagcagatggcggtgctggagtcgcaactgggcgatggatggatatggggcgatgcgttcaccttggccgacatctcgctgggtctgtcggtgcagcgctggctgctgacgccgttcgacaagccgcggttgccggcggtggaggcttattaccagcggctgcgccaacgcccggcctaccttacccacggcagcgacggcgtggcctgaggccggccgaggcccgatgccagacaaggagacaaaccatgtcggacaagcaatggaatgaagtggacgattatttcagccgcagcctggtccagcaggacgccgcgctggaagcggcgctggccgacagcgccgccgccggcctgccggccatcaacgtggcgcccaaccagggcaagtttctccatttgctggcgcgcatccacggcgcgcggcggattctggagatcggcacgctgggcggctacagcgccatctggctggcgcgggcgctgccggcggacggccggctggtgacgctggagtacgatcccaggcacgcggaagtggccgccgccaacctggcgcgcgccggccaggccgccaagacggagatccgccagggcgcggcgctggatagcctggcgcagctgatcgcggaaggcgcggcgccgttcgacctgatcttcatcgacgccgacaagcccaacaatccgcattacctggaaatggcgctgcggctgtcgcggccgggcaccgtgatcgtcggcgacaacgtggtgcgccagggcgaggtggccaacgccggcagcgtcgacccggcggtgcagggcacgcgccgcttcatcgagctgctgggcgccaatccgcgcctgtccgccaccgcgctgcagacggtgggcggcaagggttacgacggcttcgcgctggcgattgtggaggcctaggcgagcacattggccgccatgtagtcgatgaaggcgcgcagcttgggcggcatccgcggcgtggccggccacagcaggtagagattgccgctgcgccgcaccgccggcgcgtccagcctgagcaaggcgccggacgcgagctcgcggtggatggagaaatcgggcaggcaggcgatgcccatgccgcgcgcggccagctcgatcaaggcctcgccggtattgcatatggccttggacgcattgcgcaggcgcgcccatgaggaaccggaggcttacacgaatcccaccaatgaggctggtggagtgacagccccgtaacgcggcttggccgcaggcgatacacgcggctccccaataaaccgccgcgcgctacagctggcgagccacagccagctcgcccggccgccccaggtaatagccctgatatagctcgacgcccagcgcgcgcatcgcctccagctgctcggcggtttcgattccttcgatcagcatgcggctgccgatctgccagccgaattccagcagcgccggcagccggctggtttcgccggccatgtgatcgagcagcaggctgcggtctatcttgatgatgtccggggacagctcgcccatcttgtcgcggcgggcgggcagcgcgccgaagtcgtccaccgccaggccgaagcccatttccgccgcgtggcgcatgccgttcagcagcggctggccgtggtgttccacctcgaactccggcagctcgaagatcacgccgccgctgtccagctccacgctttgcagcatattgttcaacagcggcagatgggtgcggccgctctggtcctgctgcacggtggcgggcatcaggttcaggcacaggcagccgctctggctgctttgggcgaagttgcgcacgtggatcagccgcgccaggcggtcggcctccagcgccatctccggcgcttgcgcggcgagaaaacggtcgggcgcgtgccattcgccgccctcgtccaccacgcgcagcagcgcctcgtggccgaacaggctgccgcccttgtagaaaatgggctggaacgcgctcaacaggcggtagccggccaggctggcgcagtagcggccggaagcgtcgcggtacagcatgctgcccgcctgcgcgccgagagtgggctgcatcgcgcacctgcctgggagagaggacgatgtttcagcatagcaaaaacacctagcgaaatgagaaccgctaatgaaagcttgcagagtatccggccctgcgcgcgggccggcgggcctcattccgcgatgtgcagctgggtgccggcctcctgcatcagccgggcgatggccggcggcaccggcttgtcggtgaacagcgcggcgatctggttcagccggcccagctccaccagcgccgggcggtcgaacttgctgtggtcggccgccaggaacacctggcgcgactgctggatgatggcctcggtggtgcgcacttcgcggtagtcgtagtcgcgcagcgtgccgtcggattcgatgctggacacgccgatgatgccgtagtcgacgcggaactggcggatcatctgcactgtcgcctcgccggtcaggccgcggtcgcgtttcctcagcgagccgcccagcacgatgacttcgcagtccgggtaatcgcacatctgctcggccacgtgcagattgttggtgatcaccctgaggccgcggtggcggtgcagcgccttggccacttcctcggtggtggtgcccagattgatgaacaaggacgcgttgtccgggatgtggcgaaccaggctggcggcgatgcggcgcttttcctctatgcacagtacctggcgcgcctggtaggcgacgttttccacgctggatagcacgctggcgccgccgtggtagcgctgcagctgctggtgctcggccagcagcgcgatgtcgcggcgtatggtctggcgggtgacggcgaaatgctcggccagcttctccacgctgacatagctgtcgcgcctgaccatgtccagcagttcttgttgtctttgattcaggatcagcatgctagttggattctccctttgccgggaattgtaagcgatttgctctaatcgatcagcgctcgcgccgcgtcggcgatggcgaggcagctggtcaggcccggcgattcgatgccgaacaggttgaccagtcccttcgcgccgtggactgccggcccctggatgatgaagtcggcgtccggctggccggggccggcgatcttggcgcggatgccggcgtagccgggcgacagcgcgccgtccggcagttgcggccaccaggcgcgcaccgcgcggtagaaggcttccgcccgcgccgggtccacccggtaatcgacgccgtccagccattccacatccgggccgaagcgcgcctggccggagaggtccagcgtcaggtggctgcccaggccgccggcttccggcagcgggtagatcagccgcgagaacggcgcgcggccctgcagcgagaaatacacgccgcgcgcgtaatgggcttgggggatggcctccggcggcaggcccgcgagggcgcgggcgacatccggcgcgaacaggccggcggcgttgactacccggctggccaggatttccatgccggcgacgcgcaatacgatgccgtccggcgtaatctcgccgctctccagtggcgattccagcgccagctgcgcgccggccgcctcggcgtcgcccagcagcgccagcatcagcgcgtggctgtcgacgatgccggtagacggcgacagcagcgcggcggcgcaatccagcgccggctccagcgcgcgggcctcgtccgccgtcagccgctggatgtcggccacgccgttggcgcgcgcttgcttctccagcgcggccagtttggccaattgcccggcatggctggcgacgatcagcttgcccagccgctggtgcggtatggcgcgctcggcgcagtagcggtacagcgcgtcgcggccggccaggcacagcttcgccttcaggctgccggccgggtagtacaggccggcgtggatcacctcgctgttgcggctggacgcgtgctggcctatcgcctgctccgcctccacgattaccacttcgcggccgttctcggccagcgccttggcgacggccaggcccaccacgccggcgccgaccaccacggtatcgattctgtccatgtcgcgtccttaatcaggccgggcgcagcgcgcggcgcatggcgatgcgctgccgcaggccggctgcgctttccgccgccagccgcgcggccagcgccgagccggccgccggcgcgtgctcggcgtagccgtggcggtggtaaaacggcgcgttccacggcaggtgggcaaaggtggtcagcgtgacggcggcgaagccggcgccttcgccgtgggcggcgacttgcgccagcagcgcggcgccgatgccgcggcgcgcgtgcgccgggtcgacgtccatttcggccagatgcagctggccgtcgacgatttcggccatggcgaagccgacggcgcggccgtcttgctccgccgtccatagcaggccggcgtcggcggccgcgcgcagcgccgcctcgggcagcgtgcgcgcgcgcagcgccaagggcaggtcggccggagagaacagccgcgcggccaggctttctatctcggccaggcgggaaaaatcggcgcttcgggccgggcggatgacgagatcggcaatcagcatgggctcctcaattgttcggcggccagttgccccagccgggcgatggcctgttgttgcgccgcgtcccagggctggccgaagttcagccgcaggcagtggcgaaagcgcggctcggcagagaacagcatgccgggggcgaagctgatcgattctcgcagcgccgcctccagcagccggccgctgtccaggccctccggtccttccacccacagcaatagtccgccttgcggccgccgcagccgggtgccgcgcggaaaggccgccagcaccgcgtcggccacttgctccatctgcctggccagctggctgcgcaggcgctggctgatgcgggcgtagtcgccgctggccaacaggtcgctcagcgtgcccaagagcagcgccgggctgaccaggctgctgctggcgcgcagccgctccagcgcggcgtggcggcggccgccggacagccagcccagccggaacgacggcgccaggctcttggtgaacgacgcgcagtagatcacgtcgccgtcgcggtcccaggctttcagcggcgtcggccgcgcctcgtcgaaatgcagctcgccgaacacgtcatcctcgataatggccacgccgtggcggcgcgccagcgccagcagccgttttttattgtcgtccggcatcaaggcgccggtgggattctggtaattggtcaccgtcaccaggcagcgcaccggcgggccgtattgcagcgcgaactccagcgcctccagcgacaggccggcgtccggcgtgcagggaatctccagcgccttcagccccagcgccgccagcgtctgcagcaggccgaagtacaccggcgtctccaccgccaccgtgtcgccggggcgggccaggtggcgcagcgccaggctgatgccttcggtgatgccgttgcagaacaggatttcgtccgacggtatcgccaactgccagccggcggccagctggcgcagttgctcgcatagccggtcgtgctggctggccggcagataggcgccgatcagctccggccgctgctgcaacgcgttttgcagccggcgcgccagctccgccgacgggtacaaacagtggtgggcttcggccatgtgcagctgcaccgccacattggaggcggataaggccaccagctgcgacatgcggctgtccacctccaccagcgtggccggcgagggcagcgccttgtccggcttgccggcggccgaggccggcggcagcgcggcgaagaagccggcgcgcggccgcgccaccacccgctgccgctgttccagccagcggtaggcggccagcgcggtcaggctgttgacgccatggttttcagctagctggcgcaccgagggcagccggctgccgggcggaaactcgccggcgtcgagccgggtttgcagttggcgggcgatgtcctggtattgcggcatgggcttagtcgacgatgaacagcttggcgccttgcggcgcgcgggaacgatgggcctcggcgtggtccgccacctggtagctcatgccgggcttgaggatgaagacgcggccatcgtccagttcggtgtgcagttcgccctccaggcacagcaggatatggcccttctcgcaccagtggtcggccaggtagcccggcgtgtattccaccatccgcacccggatgtcgccgaactggcggctgcgccagtaggcgcggccttgttcgccagggtgttcggcggcgggaatatccgcccagtcggtgacgccgaagggaatgccgctcagctgcatgcaagtctcctgtgggagtgactgttatatagaacagataagccgcagcataaactgtttggcccagctgtgggagcgcgcgctgcgccggccgtggcacgctggcgacattggttttcatcaggagagtcgccatgtggcaaaccttgcggcgcgacgctgccccctccgccttgctggccgccgttctggcgctgttggtcggcttttccggcccgtttctgatcatcgtccatgccgcgcagtcggccgggctgtcgcaggcgcagctggcgtcctgggtgtgggcggtgtccatcggctccggcgtggccgggctgtggctgagcctgcgttggaaaacgccggtgatcgccgcctggagcacgccgggcgcggcgctgctgctggccggcctgcccggcgtgccgtatccggaggcggtgggcgccttcctcgccgccgccgccatcgtcacgctggtgggcgcgagcggcttgttcgaccggctgatggcgctgttcccgccggcgctggcggcggccctgctggccggcatcctgtttcatttcgtcggcgaagtggtggccgaggcggccggccatctgggcctggtgctgacgatggcggggctgttcttcatcggccgccgctggtttccgcgctgggggctgctggccgccatcgccgccggcgcggccttgtcggcgggcgagctgcacgcgccggctgccagcgccctgtccatcgtcgcggtgccgctgttcacctggccggcgtggtcatggtccgctttcatcaacctggccctgccgctggcgctattggcgctgaccagccagttcctgcccggcatggcggtgctgcgcgccttcggctaccaggtgccggcgcgctcgccggtgaccgcgctgggcttggcctcggtgctcaccgcgccgttcggcggccatggcgtcacgctggccgccatcatcgccgccatctgcaccgggccggaggcgcatccggaccgcagccgccgctatgtggccggcgtgttctgcgggctgatctacatcgtcatgggcgcgctgggcggcgcgctggcggcgctggcgctggccctgcccaaggcgctgctggtgaccgcggccggcctggcgctgttcggcacgctggcgtcgtcgctgggcgcggcgctggccgatgccgagcatagggagtcggcgctgctcaccttcgtggtggcggcttccggcgtcagcttcgccggcctgggcgcgcccttgtgggcgatgctggccggcggcctgctgtgccggctgttgactccgggcaagtccccggcgcaaaaggcggaaacggcggcggcgcgctagggtgggcagctggccggccggcgcggcgcgtgataagttaggcggttgtatacaatatcatccgcgcgacgacccgccgcatcgcgcgctcaaggagaaatgcatgttcgccccttccgtctatgcccagcgccgcgcccgtctgcaagcttccggcctgtccggcctgctgctgttcgtcggcaacgtcgattcgccgatgaactaccacgacaacaccctgcccttcgtgcaggactccagcttccgctacttcttcggtctgaacgagccgggcctggccggcgccatcgacgccgacagcggcgaagcgacgctgttcggcaatgacccggacgtggccgacatcgtctggaccggcccgctgccgtccctggccgagcgcgccgccaaggtggcgctgtcgcgcagccgtccgtacgccgagctggcccaggcggtggccgaagcccgcgccgccggccgtccggtgcgctacctggcgccttaccgcggcgagacgctgatcgagatgggccgcctgctggacacccatccggcgcaggtgaaggcgggcttctgtcccgagctgacccgcgcggtggtggcgctgcgcgagatcaagggcgcggaagagatcgccgagatggaagccgcgctgggcgtcacccacgcgatgcacatcgccgcgatgcagaacgccaagcccggcgtggtggaataccaggtggtgggcatcatggaaggcatcatgcgccgccatgactggcagctggcctacccgtccatcttctccaagcgcggcgaagtgctgcacaatcaccaccacgaccacgtgctgcagcagggcgacctggtgctgaacgacaccggctgcgccagcggcggcggctacgccagcgacatcacccgcactttcccggtgggcggcaagttctccacccgccagcgcgagctgtacgacatcgtgctggagatgcaggaggccgccatcgccgcggtcaagccgggcgtcaaataccaggacatccacaagctgtccgccgcggtgatggtggagcggatggccgcgctgggcttcttccagggcgacgtcgacgccatcgtcgaatccggcgcctacgccatcgccttcccgcacggcctgggccaccagatcggcatggacgtgcatgatatggaagcgctgggcgaagacctggtgggctatggcgacggcaccgagcgcagcaagctgttcggcctgggctacctgcgcctgggcaagacgctgaaggccggcatggcgctgacggtggagccgggcgtctacttcatcccggcgctgatcgaagcctgggagaaggaaggccgccacagccagttcatcaactacgccaagttccgcgaatacgccgacttcggcggcatccgcatcgaggacaacgtgctggtgaccgaaaccggcagccgcgtgctgggcgagccgatcccgaagacggtggacgaagtggaagcggtgatggccgtataagccacccggctccgcggcgagaaacgccccgcgatgcggggcgtttctgcgcccggcctgcggattgaccggccggccgcgatggcgacacaatgacgccagtctatttcgcgccggccgccatgacccacccgccgctccctgcgctccatccgccgccgcccggcctggccgcgctgttgggcgacatgctggacatcgcgctgcccggcggcccgctgctgctgccggccaccctgcacccgatgctgctgttcatcgccggcggcgacatccatttggccaaacacggcgcgttggcgccggccggcttgttgggcggcagcgccggcgtcaggctgctggcggcctcgcccggcgcccgcatcctgatggcctggctcaagcctggccaattgccgcgcttgttcggcatcgccgccggcgagatattcgacgcctacctgcccttggacagcctgctgccgccggcttggctgtcgccgcttggcgatgccgttggcgacgactggctcccgccggcgcaggcgctgctgagccgcctggctggccggcacggccagcgcgcgcccacgctggcgctgccggccgactggccccggcgcagcgcggatcagctggccgcgcatttcggcctcagcctccggcagttcgaacgccgcttccgcgccggcgccggccagagtctgcgcgctttccggccgcaggcgcggctgaaccgcttattgctgcatgcccgctggacgccgtcgcccgactgggccgatgtggccgccgccgccggctacgccgaccaggcccatctgcaccgcgatttcgtccgcttcgccggccgcacgccgtcggcctatgtccagggactgggcgacgacccggcgctgcggctgtaccgcttgcccagagaggctattctgcggatgtgcgccgaacccggcctgcgcgcctgacgcgcgtcgtttcgcttcaagacggccccgccgcggttcggcatgctgtgctcatctctagccagggaggcctccatgtctgtccatcacgatttttccgccattccgccgctaaccgacgccgccagccgctatccctggcaagactgctgcagcgtcccgctgccgcccgatgcgccggcggccgacgccgccgacttgttgcgcgccttttcccgcgcgatgccgccctgggcccgcgcgctgatgcggctgcgcgaccggctggtgtcgccgctgggcctgaagattgaccaaaccaaccacactggcggggcgccggtcgagcccttccatgtcggccagcaactgggcgtgttccgcgtgctgtacctgggcgagcgcgacgcggtgctgggcgaggacgaccgccatctggatttccggctggtgttgcagtggcggccggggcgtttgcatgtgagcacgctggtgcggccgcataatggcttggggaggacgtatctggcgctggtgacgccgtttcatcatcttattgtggccgcgagcatgaagagaatggccgaggcattggggtgagatgttagggcgcgtcgcccctgcggggggaagcgccttgcagatgagatcgaaccggcgtggccatgcccccttcgcgccacccacaggctatccagaggctatccagaagttatccaccgctttatccacagccttgcgccggccagcgccgcgcaatgacaaacaggccgccggagtgctccggcggcctgtcgcatggggcaggggggcgggtttagccgcgcgccagttgggtcgcttcgcgcgccagctgggtgatgcggccccagtcgcgggcggcgatggcgtcgtccggcgtcagccagctgccgcccacggccagcacgttcggcagcgccaggtattccggcgctttcttgatgtcgatgccgccggtcgggcagaagcgcaggtccgggaaggggctggccagcgacttcagcagcttgacgccgcccaccgcctcggccgggaacagcttcagcgtgttgaagccttcgtcttgcgcccacatcgcttcggacggggtggcgatgccggggatcagcgtcagctgcgacgcgcgcgccgccgaggccagctcggcggagaagccggggctgatgccgaactgcgcgccggcgtccaccgccgcttccagctgggcgcggttgcgcagcgtgccggcgccgacgatggcttccggcacttcgtcgcgcatgcggcgcatcgccgccagcgccgccttggtgcgcagcgtcacttccagcaccttgatgccgccgtccaccagcgcgcgggccaggtccaccgccaccgcggcgtcgttgacgatgatcaccggaaccaccgggccctggcgcagtacagtcaaagcatccatgtatttctcctgttggcgggcggcgcttggtccgcgccgccttgctgaatcatgcgggccgggctcagttccaggccgggtggcggaagctcatcgcgccggcctcggcttcgtcggccgtgtggcggaagccggcgaacaactcgcggcccatgccgtattcattgtgcgacagatcggcctgaacctgttcgcgcgccgcccattcggcggcgttcaccagcgcggccagctcgccggtatgcgcgtcgacgcggatcaggtcgccgtcgcgcaccttgccgatggcgccgccggatagcgcttccggcgacacgtggatggcggccggcaccttgccggacgcgccggacatgcggccgtcggtcaccagcgccaccttgaagccgcgctcctgcaggatggtcagcgccggggtcagcttgtgcagctccggcatgccgttggcgcgcgggccctggaagcggatcaccgcgacgaagtctttttccagctcgccgcgcttgaacgccgccagcatgtcgttctggtcgtggaacactaccgccggcgcttccaccacgcggtgttccggcttcaccgccgacaccttgatcaccgcgcggccgatattgccggccatcagcttcaggccgccgtcggcggagaacgggttggaagccgggcgcagcacgctgtcgtcgccgcttaccgccggcgcgtcgcgccatttcagctcgccgttgtccagccacggctcacgggtgtaatgcgacaggccgcggcccatcaccgtgcccacgtcttcgtgcagcaggccggcggccagcagttcgcggatcacgaagcccatgccgccggcggcgtggaagtggttcacgtcggccttgccgttggggtaggcgcgcaccagcagcgggatgacggccgacagttcgtcgaaatcgtcccagttgatgtcgatgccggcggcgcgggcgatggcgacgatgtgcatggtgtggttggtggagccgccggtggccagcaggccgacgatggcgttgacgatggatttctcatcgatcatctcgcccaccggggtgaactgctcgccctgggcggcgatcttggcggcctggacggcggcggcgcgggtcagcgcctcgcgcagcgcggtgttagggttgacgaaggcggcgcccggcaggtgcaggcccatgatctccatcagcatctggttggagttggcggtgccgtagaaggtacaggtgccggggccatggtaggactggcactccgattccagcagcgcgtcgcggcccaccttgccctcggcgtacagctggcgcaccttggccttgtcgtcgttggcgatgccggtggtcatcggaccggccgggacgaacagcgccggcaggtggccgaaggtcagcgcgcctatcatcaggccgggcacgatcttgtcgcacacgcccaggtagagcgcggcgtcgaacatctggtggctcagcgccaccgcggtgctcatggcgatgacgtcgcggctgaacagcgacagctccatgccggcctggccctgggtgacgccgtcgcacatcgccggcacgccgccggcgaattgggcggtggcgccggccgccagcgcggcttctttcagccaggccgggaaggcctgcagcggctggtgggccgacagcatgtcgttgtaggaagacacaatcgccagattggggcggtgctcttccttcagatggattttcatattgtccggcatcgccgcgaaggcgtgggccagattggtgcacgacaaatgggcccgctccacccggccctgctgggcggcggcgcgcgcgcgcgcgagataggcgctgcggcgcgcttggctgcgctggacgatgcggtcggtaacggcggacagggtgggatgcaaggccatgatgacgttccgtgatgaattgaagcagatggtagttttactacacgcaaaatgcaaggcgcgctacgcgccgccgacggcggcctagcgtgactatccgctttcccgcttgagatttccagcggaatttcccgattgttgagccagggcaaaaggtgttgcaaaagcggccacttgcggggttccggcatagacagcgcggtatcgaatggtaatataactacatctaatacacttcgagatggaagatcaggatggagacccgttctacccctaccccggccttcgacatggtgctgttcggcggcgccggcgatctggtgatgcgcaagctgctgccctcgctgtaccaggcgcacgccgccggcctgctcaacgagcagggccgcatcctggcgctgggccgcaaggacctgagccgcgacgactacctggcttccgtcgagaaacaatcccgcatccacatcaagagccacttcgatgacgccgcctggcaaagcttctgcgcccgcatcgactacctgaaggtggacgcctcgcaggcggccgactttccggcgctggcggaaaaagtcggcgacgacagcggcaaggtggtggtctgttacctggccaccgcgcccaatctgttcgccggcatttgcgacaacttggcggcggtggggttgaaccgccccaatgtgcgggtggtgctggaaaagccgctgggcaccgatctggagtcgtccaacgagatcaacgacgatgtcgcgcgcttcttcaaggaagagcagctgtaccggatcgaccactacctgggcaaggagtcggtgcagaacctgatggcgatccgcttcgccaacgcgctgttcgagccgctgtggcgccgcgaatggatacacgacgtgcagatcaccatctccgaggagctgggggtgggcagccgcggcgatttctacgacggcaccggcgcgctgcgcgacatggtgcaaaaccacctgctgcagctgctgtgcatcgtggcgatggagccgccggccaatatggaagccgacgcggtgcgcgacgagaagctgaaggtgctgaaggcgctgcggccgttcagcgagcaggacgtcgccgccaaaaccgtgcgcggccagtacaaggccggcgccatcggcggccagccggtggtcggctaccaggacgagaacggcatcccggccggcagccagactgaaaccttcgtcgccctcaaggccgagatcgacaactggcgctgggccggcgtgcccttcttcctgcgcaccggcaagcggatgcaggagcggctggccgaaatcgtcatcaatttccgcgacgtgccgcaccagctgttcaccggcccgatgggcggcagccacaccgccaaccggctggtgatccgcctgcagccggaggaaagcatccgcctgtacttcctggccaaggagcccggcgacaccatgcgcctgcagccggcctacctggacctggacttctacaaggccttcaaggtgcgccgcgccgacgcctacgagcgcctgctgctggacgtgatccgcggcaagctggcgctgttcatgcgccgcgacgagctgatcgaagcctggcgctgggtggagccgatcatggatacctggagccgcagcaacaacgccccgcccaagcagtacaccgccggcagctggggcccggcggcctccagcgcgctgctgtcgcgcgacggcataggctggcacgaggagtgttaaggcagggcggaagcccccaaagggggcgttccgcttttttcatcttcatcgccgaacatggcggagcgcccgcatggcgggcttccgccttacgaaaacaccgccaggacggaaaatccgcatagccgttttccgccctggcaagccacaaccgaggtacgcgtatgaactggttggaattccccgacgccgcgcagcaaaccgacgcgctggccaacagcgtggcttcgcggctgtccgccgcgatagccagccgcggccaggcggtgctggcggtgtccggcggcaagtcgccgatcccgtttttccagctgctcagcgaaatggcgatagactggtcgcgcgtcaccgtcaccctggtggacgaacgcttcgtcgcgccggaccacccggacagcaacgccggcctggtgcggcaacacctgctgcgaaaccgcgccgcgccggcgcgcttcttgccgctggtgcgcgccgccgccgacatcgacgccgaagtggcggccgattgccatgaattcatcgcgcccgacgtcgcggtgctgggcatgggcgaggacggccacaccgcctcgctgttccccgccgccgccgaactggccgccggcctcgacccggcaggcagccgcccgctgctggcggtgacgccgccggccgcgccgcaccgccgcgtgtcgatgagctacgccgcgctgctgcaggccggctgcctgatcctgtcgatccagggcgcgaaaaagcgcgaggtgctggaagccgccgcccgcggccgcgacgacgcgctgccgatcagccatttcctggcccaggacaaggcgccgctcgatgtctactggtctgcctgaagcctggccgcggctgctggccgacatcggcggcagcaacgcccgcttcgcgctggaaaccggccccggggtgatagaagacatcctggtgctggccaacgcgcagtacccgacgctggaagacgcgctgaaaagctatctggcccaggtgggcgcgcgccgcgtcgcccacgccgccatcgccatcgccaatccgctgaacggcgactgggtggcgatgaccaactgccactgggcgttttcgatcgaggccacccgccaggcgctgggcttcgccaccttgctgctgctcaacgatttcaccgcgctggcgctggccctgcccgggctgccgcgcgccgagctggagcagataggcgtcggcgcggcccgcgccgacgcgccgctggcgctgatcggccccggcaccggcctcggcatgtcggcgctggtgccgcatgccggcggctggcgcgcgctgtccggcgaaggcggccacgcctcgttcgcgccggccgacgagcgcgaagccggcatctggcgctacgccgccgcgcgcttcggccatgtctcctatgagcggctgctgtccggccccggcctggaattgctataccaggcgctgagcgcgcgcgacggcgaaagcgccgagccgcgcggcgcggccgaaatcagcgcgctgggcttgtcggcgcgctgcctgcgctgccgcgaagcgctggaaatcttctgcggcatcctcggttcggcggccggaaacctggccttgaccctcggtgcccatggcggggtatatataggtggtggtattgtgccgcgtctgagcggtttttttgaacaatccccatttcgccgccgtttcgaggacaagggacggatgtcggcctatctcgccgccatcccggtttatctgattaccagcgcctacccggccctgccgggcgtggccgcccatctggcggcccatctggcgtcgcgcagcgaccatgccccggtggatgcctccacccctcctcgaggcggctttgcaggagacatgcatgcttgatcgcatccgaggccaactggagacgctgtcttcggccgagcgcaaggtggccgagctggtgctggaacaaccctacaccgtgatccaggccgcggtggccgacatcgcgcgcaacgccggcgtcagccagcccaccgtgatccgtttctgccgcaccgtcggttgctccggcctgcccgacttcaagctgaagctggccggcagcctggtgaccggcgtgccctacgtccactccagcgtgcgtccggaggacccgacctcggaaatcgtcgccaaggtgttcgacaacaccgtgtcggcgctgctcaagtgccgcaacgacgtcaatccgcaggcgatagaagccgcggtgcggctgctgaccgacgccaaccgcatcgaattctacggcctgggcaactccggcatcatcgccgccgacgcccagcacaaattcttccgcttcggcattcccaccgtcgcctattccgacacccacatccagatgatggcggcgtcggtgctggggccggaggatgtgctggtggccatttccagctccggccgcaccatggagctcttggaagcggtggacgtggccatcgccgccggcgccaaggtgatcgcgctgaccaccagcggctcgccgttggcgcgccgcgccacggtgtccttgatcgccgacacgctggaagacaatgaaacctatagcccgatgatctcgcgcatcgtgcacctggtgcagatcgacatcctggcggtgagcgtggcgctgcgccgcggcccgggcctgatccgccagctggaaaagaccaagcacagcctgaagaaccgcaggctggacaatagacaaccggaataggacatacgtcatgagtgaactgaccgaactgccggcctggcaggccctgtgggaccatttcgccgaggccaggcacctgcacatgcgcgagctgttcgccgccgatccggagcgggccgagcgctattcgctggaagtgggcggcctgttcctcgactattccaagaaccgcatcaccgacgccaccttgctgggcctgatgcagctggcgcgcgaagccggcctgccggccaagatcaaggcgatgttcaagggcgagaagatcaaccgcaccgagaaccgcgcggtcctgcacgcggcgctgcgcaaccgcaccaactcgccgatcctggtcgacggcgaggacgtgatgccgaaggtgaactcggtgctggagcggatgggccggttttcccacgcggtgcgctccggcgactggctgggctacaccaatcagccgatcaccgacatcgtcaacatcggcatcggcggctccgacctcggcccgctgatggtctgtagcgcgctgaagcccttcggccatccgcggctgaacatgcacttcgtctccaacgtcgacggcgcgcagctgaaggaaacgctgaagaaggtgcatccggagaccacgctgttcgtggtggagtccaagaccttcaccacccaggagacgctgaccaacgcgctgaccgcgcgcgagtggttcgtggcgcgcgcgcgcgacgaaaaggcggtggccaagcacttcgtcgcggtgtccaccaaccagaaggcggtggccgacttcggcatcgacccggccaatatgttcgaattctgggactgggtgggcggccgctacagcctgtggtcggccatcggcctgcccatcatgctgtacctgggcgaggagaacttcaccgagctcctcaacggcgcccacatcatggaccagcatttcaagaacgcgccgttcgagcagaacatgccggtgctgctggcgatgataggcgtctggtacatcaactactacggcggcggctcgcacgtaatcgcgccgtacgaccagtacctgcaccggctgccggccttcatccagcagctggacatggagtccaacggcaagaagaccatgctggacggccagccggtcaatttcgagaccgcgccgatcatctggggcgaaaccggcatcaacggccagcacgccttcttccagctgttgcaccagggcacccacatttcgccgatcgacctgatcgcctcgctggaaaaccgttccagcctgccgggccaccacgagatcctgctggccaacgtgttcgcccaggccgaggccttcatgcgcggcaagaccgccgacgaggcgcgcgccgaactggccgagcagggcctgaagggcgaggcgctggacgaattggtgccgcacaaggtgttcgacggcaaccgcccgaccaacaccctgctgatgagccggctggacccgcgcaacctgggttcattgatcgcgctgtacgagcacaagatcttcgtccagggcgtgatctggcacatcaacagcttcgaccaatggggcgtggagctgggcaagcagctggccaagaccattcacggcgagctgaccggcaagctgccgctggcggcgcacgacagctccaccagccggctgatccagctgtaccgcaaggccaacgcctgagccgccgcgccgtcggtttccctgatccgcccccgcctcgcgcgggggttttgtttgcctggcgccacagtcgggatttccccgattgtcggacaggatgccggctgctgaaatggcgggccaagtcagacaaaaacaacggactgaagaagaatcatcgggatgtgtaagttgcgcagtaccttgctggccggcgtcctgctggctttcagcctggccggccatggcgccggccagcctgtccacccggccggcgacgccgccgctcccatcattctcagcggcaccgtggtcgggccgctgcacaccggcagcaaggccgagggcacgtttttccaggcttatcacctgaagctggcgcggccgctgcgcttcgacgacggcgcggcttgcggcggccagcgcctgtccagcctggcgctgagccagccgggcatggcccgcttcaagggccgcgcggtccgaatccaggcgcgggtgttctgccaggaagaccgcggcgccacctaccggctggcggatatcagcctgctgtaggcgctgcggtcatttcaggcggcagtcgttgccttccagcgtgtaattgacgatgatcccggcctgcaccatgaacgtgcgtttgcagaagttctgccggctgctgaagccgccggagccgttttgcacgtcgccgtagacggatgtcgaggcgcgggtgtagctcaggtaagtggttttgccgttgacgtagctggcatctggcgcgcccagctccgacaggagctcggcctcggtcctgcccagctggatgtcgcggatgaaggtctcgatctgattccagttccagtcgtactgggtgtagtaatagcgctcgttgccgctgggctcaatcttcaacgccgagcaatcgccattggcccgggtcaacctggggtaggcgttgctgtagtcatggtacatctcccactgcgcgcccgagacggaacgccacaaggtcacgcattggccgacgctgtagcccggattgccggatacgaccagattgatcgcgccgcgcgcgtccctgacccgatacagggtcagcgggccgaaattcagctttttccgggaagtgaatgcggatttggactcgatcttcaccggaaaggatttcgagcgggccggaggcgcgttgccgagaacgggcgcttcccgcaggcgctcaacagggttgccgccagcagcggcatcatcacggttttcatcaacatcgcgctttctgcttcggcatgcgcggcgcggggcggcatgcctttgttttgcgtaaagcggcgattttagcatttcgggatgcggcggccgcaagggcggacggcgccaagccgcgggcttacgccggttgcgggaacatcgccgccagctcccgcgccgccgcggccgggtccagctggtcgaacaggccgcctatcaccgcgatggcgtcggcgccggcctggatggcctggccggcgttggcggcggtgatgccgcctatcgccacccgcggcagccgcagcgcggccgcctcggcgaacagcgacagcggcgcggccgccgcgccgggcttggtctgcgacggaaacaccgcgccgaaggcgacgtagctggcgccggccgccgccgcccgccgcgccagctccaactggtcgtagcaggacgcgcctatgatggccgccggccccagccgcgcgcgcgcggcggcgatgtcgccgtcgtcgcggcccaggtggatgccgtccgccccggtcgccagcgccagttcgatgtcgtcgttgacgatgaaggcggcgccgcggccgcggcacaggctggccagcagattggcctgccacagccggcgcgccgggtcgcggctcttgtcgcggtattgcagcacccgcgcgccgccctccagcgccgccgccgccagttccagcagcctttcgctgtcgcagccgtcgggcgtgaccgcgtacagcccctcaatccggtttgccatcgccgtcctcgtcgtcgccgcgcgcccagaacatgcggtcgggcaggaattggcccatgccggggcggaagccgttgagcagggtctggtaggtgtattcctgcgcctcgcgcaccgcttccggcagcagcaggccggtggccagcatgccggcgatggcggacgccagcgtgcagccggagccgtgatagctgccgggcagccgctcccagtggtcggcgcgcaccacgccgtccgggctgtacaggctgttgacgacttccttggtattttcgtgggtaccggttatcaacagataggggcagcccagcgccaggatgcgctcggcgcactggtccagcgtcagttcttcgtcgtcgtccgggtcgttgctggccagccggcgggcctccaggctgttgggcgtcaggatcgacacctgcggaatcagtatgtcgcgcatcgcgcctatcaagtcctcgtcggccagttcgtggccgccgccgctggccagcaccgggtccagcaccaccgggatgtcggggtagtcggctagcagctgcgccaccacggcgacgttttccacgctgcccagcatgccgatcttgaacgcggccaccggcatgtcttccatcaggaagcgggcctggtcgttgacccagtccgcgtccagcaccatcaggtcgttgacgccgacggtgtcctgcaccgtgatggcggtgatcaccgacagcggatggcagcccaggctggccagcgtcaggatgtcggcctggatgccggcgccgccggaggggtcggaaccggccagggtcagtaccacgggaggggagggaggagtggtcaagggctaacctcttttgttttattgcggtggcacgatttagaatgttcattttatccgaacacgagggcgaagcgatgcgtacttggatgtgtctgatctgcggtttcatctacgacgaggaagccggccggccggaagacggcatcccgcccggcacccgctgggaagacctgccgcccaactggacctgtcccgattgcgacgcgcgcaaggacgatttccagatggtggagatctgaccgcgatgtccacgcaatggaaacgatggctgtccggcgccgcgctggcggcgctgttggcggcttgcgcccaggtcagcaccaccggcggcggcgcggtcggcgtcagccgcagccagagcatgctgctgtccagccaggaagtggcgcagatgtcggccaaggcgtacgcgcagcagctgggcgaggcgcgcgccgccggccggctcaacaccaacgccgcgctgaccgcgcgggtgcggcgcgtgtcgcagcggctgatcgcgcagacgccggccttccgcgccgacgcccggggctggccctgggaggtgaacgtgctcgctaccgacgacatgaacgcctacgcgatggccggcggcaagatcatggtctactccggcctggtcagccagctgaagctgaccgacgccgagctggcggcggtgatcggccatgagatctcgcacgcgctgcgcgagcacacccgcgagagcatgagccaggaatacgcgcagcaggccggcctgtcgctggtgggcgcgctggccggcttcagcgccgaccagctgaaactggcttcgctggtgaccgacgtgacgctgagcaagccgcatagccgcaccatggagtccgaggccgacatcatggggctggaactgatggcgcgcgccggctacgaccccaacgcggcggtgaacgtgtggcagaagatgcaggcggccggcaacggcggcggcatggagtttctgtccacccacccgtccggccccacccgcatccgcgacctgcaggcccacatcccgcaggtatggccgctgtacctggccgcgccgaaaaagggctgagcgatggtcctgtccgccgccttcctcgacgacatgctgggctacgcccgcgggctgcccggcgccgttttcgacgtcaaatggggcggcgtgcgggtggtgtcgatcggcggcaagatgttcctggcctgcggcggcgacggcctgagctacaaggtggccgacgacgacttcctgacgctgtccggcctgcccggcgcgcggccggcgccttacctggcgcgggcgcgctggatccaggtgttgtccaccgaggcgctgtcgccggacgacatccgcgcgggcatcgcccgctcgcgcgaactggcgctgagcaagctgcccaaaagccagcgcctggcctggcaatgaggcggcgggccgcgcgcccgtccgcctccacaaggaaaccccatgagttatctgtatctgaaagccttccatatctttttcgtggtgtcctggttcgccgggctgttctacctgccgcgcatcttcgtcaacctggcgatggcgcagcagccggcggaatacgaccgcctgctgcagatggcgcgcaagctgttccgcttcatgacgccgctggcggtgctggcggtgggcaccggcctcgcgctgtggctggatttcggcatcggcggcggttggctgcacgccaagatggcgctggtgggcgtgctggcggcgtatcacggctattgcgccaagctgggccgcgacttcctcacccacagcaaccgcaagagccatgtctggttccgcgtgttcaacgagctgccggtgctggtgttgctggcggtggtgatcctggtggtggtcaagccgttctgatgggagcgttgcgatgaggcgcgcatggtttgccgggccgttgctggccggctggctggttcaggccgccgccgcggccgctttgccgccggcgctgctgctgagcgtggagcgcgacggcgaagtcgtgcggcaactgccgctgtgcctggccgccgacggcggcttcggcgccgatcagcagcgcgacggcgcggcgctggaggtgagcggccggctgcaggcgctgcgcaaccatccgcacccgctgctcagcttccggctgagctggcgcgacgaggccggcgcgcaacagctggacagccagctggcgctggagggcggccgccagctgctgggcggcttgccgctgctggtctacccctatggccatgcgcccggcgtggagccgcagcgcagcagcctcactttttacctggagccgcaggcggcttgcccgccggctgcgccggccaaaacaaaggaatgaatgaatgggactggaaatcgaacgccgcttcgtggtgagcggcgacgcctggcgcggcctggcgccggcggtgcagtaccgccagggctatctgtcggtggagaaggagcgcaccgtgcgcgtgcgcgtggtgggccagcaagcctggctgacgctgaaaggcaatatcagcgatgtcagccgccatgagttcgaatacccgattccgctggccgacgcccagaccatcatggcggcgatgtgcccgatggtggtggacaagctgcgccaccgcatcgagcacggcggcttcgtctgggaagtggacgaattcttcggcgacaacgccggcctggtgctggccgagatcgagctgcctagcgaggacacgccgttcgccaagccggcgtgggtgggcgaggaagtcacccatgacggccgctacaccaacgcctatctgtccaagcagccctacacgcgctggtagcgcgggaacgggcagccgccgctgacgcggcgtcggctgcccgcatgcaagactaggccggcgcatgctccggtcgatgcgccaggctcagcccaaagcccatcacggcaatcgagcatcctcccagcatatatatcgcccgataataagacagccctatcatgatcgccgtcacccctagcagcaaagcggctgccagatagcagaacttgccccgcgcatggcttgagcggctttgccatatcgcgatcagcaagctcaaagaaccgagcaggtacaaaaacagctcccgcgccagcatcagcaccgacatcgccccgagatcggtcagatgaaagacctgacgaaaataaagcggggagatcaaggcatagatgccaaacagcgaaaacagaccccaacgagccaacttggccatgccaaactccaaagtatccagtgcgggcccgactttaccgttttcccggccgcggctctagcggcatcgcttcctgaatcgccatcggctggcggcggcattcgtccacctccgccccccttcgccgcaaaggcgcttgttccggagccgatccattccgtccctgcgcccgcgggaccgctcttctttgacgccccgcaggattagggatgcctcacttatccacagcaatcccgcttttccaatcttatccacacgccacccatcgagaccgccactcgggtaaaatggcggcatcacgacggccccatctgcgccgccgcgccctctcatttcgcggctgacgccgccagacaaggaaaatccatgtcccgcaatctggaactgttcgaacgtggcaagaaagtgatccccggcggcgtcaactcgccggtgcgcgcctttggccaggtcggcggcacgccgcgcttcgtcgcccgcgccgaaggcgcctatttctgggatgccgacggcaaacagtatctggattacgtcggctcctggggcccggccatcgtcggccacgcccatccggaggtggtgaaggcggtgcaggacgccgctgtcggcggcttgtccttcggcgcgccgaccgagggcgaagtggtgatcgccgaggaaatctgcaagctactgccgtcgatcgagcaggtgcggctggtgtcgtccggcaccgaggcgacgatgaccgccatccgcctggcgcgcggcttcaccggccgcgacctgatcgtcaagttcgagggctgctaccacggccattcggacagcctgctggtgaaggccggctccggcctcttgaccttcggcaacccgtcgtcgggcggcgtgccggccgatttcacccaacacacgctggtgctgcagtacaacgatgtcgagcagctgtcgcgcaccttcgccgagatcggcgacaagatcgcctgcgtgatcctggagccgatcgccggcaatatgaacctgatccagccgtcggccgagttcgtcaaaacgctgcgcagcctgaccgagcggcacggcgcggtgctgatctacgacgaggtgatgaccggcttccgcgtggcgctgggctgcgcgcagagcctgcacggcgtcaagcccgacctcaccacgctgggcaaggtggtgggcggcggcatgccgctggcggctttcggcggccgcgccgacatcatgggcaagatcgcgcccctgggcaccgtttaccaggccggcacgctgtccggcaatccgctgtcggtggccgccggcctcgccacgctgaagctgatccagcagcccggcttccacgacaccctgggccggcgcagcgcgcggctggcgcagggcctggccgaagcggcgcggcaggcgggcgtcacgctgtccagcgacagcgtcggcggcatgttcggcttttacttcagcgccgcggcgccgaagtcgcacgccgaagccacccgctgcgacatcgaggccttcaagcgcttcttccacgcgatgctggatgagggcatctacttcgcgccgtcggcctacgaggccggcttcgtctccatcgcccacagcgacgagatgatagagcagaccatcgccgcagccggccgcgccttcgcgcgcatctgacgcggcagcggcggcggacaagggagcccaggctcccttttttattgcgctgaagaaatccggccgaattggtaaaattcccgtgcattgcaaaaacgataccggccgatcaggcctgcgggacattgtggttcaagggggatgtggatggaaaggaagaccaggctgcgcctggccgcgggcgcgtgcgcgctggcggccgcgaccctggccgtcggctggctgctgaggggcggcgaccagatcaaagtggaaaggctggcattggcggccgcgcccgggcgcgaactggcggccagcctgatgaaccgggcctacggcagcgagcagcatgacgcgcggcgggattgctggcattacctgcgcgaggacggcggcgactactgcctgcgcccgctggcgctggacagcgccgcgatcggccgcgagcgccggctgtacctgttcgccggcggcggcaaggatggcgcgcgcgacgaggagcgcggcggcatggtcggcgctttcgtcgccgacgccgataccctggcgccgatcgccggcagccgggagctggattttctcaaccagaaggccgccggcccggagcaggtgcagttgctgcaattgtccggagacggttatatgggctggttcgcggccggccgcgccggcgtcgaggagtttccgcagttttacgcgcccaggggcgacgaggtggtggcgataggcggcgaggtattcggccgcgacgccgatgccgtcgccgggctgaagttcgcctaccagctggacagcgcccagcgcggcggccgggtctacccgctgtcgctggtcgtccgcgacggcaaggacaagcagttggccagtttcgatttccgtttcgaccgccgccgctgggaatatgtttgcgccgatgtcgactgccgggtgcgcgccggtctgccgacgcggccggagcgggtggcaaacgcccagcaagcgccggcggccgacgccaacgaagcgctgttcggccgcggccgcaagttgtccgacgccgatctgcgagacgtgctgggccaattgggcatgcgctacgtcgccgaggacggcgcggccggcttcgtcggccagaacggctgcgacgcgccctatccgctggacgcccatttcgagcgcgacggcggccaggagcagctgtgggtgcgcggcggcgacggttgcacttcgggcgcggccggcgcgtcggtctgggtgtttgtccgcggcgacgatggccgcctgcgcgccaatctgggcatgccggccgccgatgtgcgccgcacccgcgacgtgtcggcgggcgtgcatgacctgcgcgtcggctcggccggtttctgcgaccggctgtggcgctggaacggcaaggccttcgtccatctgttgaacattcccacccagagcggcggctgcgacggcgccgatctctagcggaacggcggcgcgggccgccgtttcgttttccagccgtcctgcctgccctgtccgttcgccagtcaagccacgcccctcacttggcctgatagaatgacaagtcaaatttactgacgagtattttttcaattggcatcaagccatccgggttaagaccattatgggaaacaagaaaaaactcgcgttgctggcaggcggcgcgctattgctgatcgcagtcggcttcggcggctggaaatattggaaagcgcaccaggcggtgcaggtggagcggctggcgctggatggggagcccggaaagcaactggccgacgacatcatggacaagatgtatggccgggacgcgcgcgatggcaagcagggctgctggaacatcgacgccggcaatggcggagaagaaaccgtcgcctactgcatgaagccgttggccttggaccgtgtgcaggcagaaggcgaggagcggctctatctgttcgccggcggcagcttcccggatgccagccatgccgactcgcaggccttggtcggcgctttcgtgatcaatgccaagactcaggaattgatcgccggcgaccgggaattgccctttgccaacggattcgccagcgcgcccagcgaggtgaagctgctgcccttgtcggcgaccggctatatggcctggttcgccgagggcggcgacatgcatcagggaatttccgccagtttcccgcagctgttcgcgcccaagggcaagaaggtggtggagatcagcggcgacttgttcggcaagagcgaaggcatgtcggaggagctgagcttcgactaccggccggacgcgtccaaggccgatgccaaggtctacccgctgttgctgacggtgaaacaggacaaggacaagacggcggccagcttccgtttcgtctttgaccacaaagcgtggcattacgtttgcgccgaccaggcctgccgcaagcaacagggcattccggcatatcaggagccggcggccgacgacgatgacggcgagcagccggcgcagccgccggccgacgccaacgccgccttgttcgacgacggcaacaagctgtccgacgccgacctgaaggacgtgctggcggcgctgggcgcgagctatgtggtcaaggaccaggacaactggggcttcgtcaccgagcaatgccggcagccgttcaagctgagcgcttcctacccgagcgacgaaaaggacagccacaacgaactgtggctggaaggcggcagcgcctgcacctccggcaccaccggccagagcgtgtggctgttcatccgcggcgaagacggccacctgcgcgccaacctgggcgtgccggccagcaagaccgtggtgaccggcgacctcaacaacggccgctacgacctgcgcctgtccggcaacggcttctgcgaagcggtgtggcgctgggatggcagccagtacgcgcatctgaagaacatcgccacccagcccggcggctgcggcggcgagtaagaacagacggccgcaagcctgcggccgcgctggccaaagattttccaaggatattccgtgaaattcaacaagaaacactggatcgcgctggcgatcgtcggcgtgctgctgctgggcctgatattcgccgcctaccgcgtgctgcatcagagcaatggccgcgccgagcggctggacctgggcagcgagcagaatcgccggctggccgccgaactgatggacaagctgtacggccatgacgcctacgacggcaaacagcattgctgggccaataacgacagcgacgccgactactgcatgaagcccgtgcagctggaccgcgtcgacagcgccgccggcccgcgcctgtatctgctggccggcgccgacggccacactgtgcaaaccgagaccggcggcctcgatctctggagcgcgctgggcgcggccatcgccaatggcgacagccatgaactgatcgccagcacccggatggtgtccttcatcgacgacgcccgcaaggcgccgtccgatgtccggctgctgcagttgaatggcaagggcgacatgggctggttgctggagggcatgacgagccggcgcggcgagccgctgctgttggccgcgcgcaaggatcagatcgagaatatcggcggcgagctgttcggcaagctgccgagcgatgccgagcagcgtttcgactaccgcgtcgaagccggatccggcgacggctattatcccttgcaactgagcgtcggcggcgacaagcaacgctaccgtttcgtcttcgacgacaagaccggcctgtatcagtgcgccgatgacgactgccgccagcgctggcagagctggtccgacgccggcaatgacacttccgcgcagaacgatgacagcggcgatgagagcgcggcggccacgcagccgccggccgacgccaacgccgccttgttcgacgacggcaacaagctgtccgacgccgatctgaaggacgtgctggccgcgctgggcgcgacctatgtggtcaaggaccaggacacctggggctttgtcaccgagcagtgccggacgccgttccgcctgagcggctcctatggcaagacgcatgacgaggaccacaacgagatctggatccgcggcggcgacagctgcacctccggcgcgaccggccagagcatctggactttcgatcgcgacgacgacggccatctgcgcgtcagcctgggcgtgccggccaccaaggtggtggtggtgaccgacggtccgaacagcccggacgacaatccgcgcaacgacatccgcctgtccggcaacggcttctgcgaatcgctgtggcgctgggacggcaagcagtaccagcggctgcgcaacgaggccacccagcccggcggttgcgaccgcgagccggcggcgcagcagtaagcgctcctgagtgcgataggaaacggcggcttaggccgccgttttcgcattcggctttgcagcgcgggccgaatccggcaacatcggcgcgactttccttttcccgatgagcgatgactgaagcgcaatcctccacccggctgatctggcggctgcgcctggccgactccggcgtccagctgcaaccactgctgcaaagcgccggccccgacggctggagccgcggccgcgcctgcgcgctggccggcctgctgcgggacgaggcggcggcggtgcgtccgcacgatctgcccttgctgaaaccgttgctggcgctgtggcaggcgcatgacggcgatgccggcctgatcgacgccgcgcccttgctgccggccttggtcgaccatccgctgttgttcgacgccgacgcgccggcgcggcgcatccgcgtcgaagccggccagccggcgctgcagatggagcgtgtcggcgcggagttgcggctgaagctgctgccggaaggcctggccggctgtggcggcgtgttgtggcggcggccgcagccggagcggctgctggtctaccaattgaccgatgagttgaaggcgctggccgatctggtcggccacggcctgaccgtgccgtggcaggcgcggcagcgggtgctggaggcgatacgcgacgtcgcgcccggcttgcccttggtggacgccagcccgcaattcgacgcggcgctgccgagcgaggcggccgatgccacgttatacgccttgttgacccggcaaccggaaggcttgcggctgcagctgaaggtcaagccgcatccggcggccgcctggagcgcgccgggccgcggcgcggccgggctggtgctggacgtcgacggcgaatacaggcagttcatccgcgatctggccgacgaggctgcccggctgcgcgcgctgcgcgaggcctgcccggcgataggccgcggccagcgcgacggcgacggctggctgttttcagaccagcactcggccttgtccttgctggcgcagttgcaggcggccggcgaggagcgcgtcgcctgcctgtggccgcacggcgacaaaatccgcctggccgccgccgacggcatgccgcagctcaagctgaaagtgaagcggcgcggcggctggctgcaggcagacggcgaactggagctggatgatggccgcatcctgacgctgcgccacctgctggcggcgctggccaaccaaaagggcaagtatctgcagctgtccgacggcgactggctggccttgtccggcagtctgggcgaacgcttgggcgagctggcgcggatggtggaccacgccgggccggacggtttggcgatcagcccgctggccgggccgcgcttgcaggcgctgggcgaggaggctgggcagttcgacggcgacgacggctggcagcgacaggcggcgcgctggcgcgaggcggctgttttcgatccccaggtcccggcgacgctgaacgccacgctgcggccttaccagctgcaaggctttgcctggatggctaggctggcgcattggggcatgggggcgtgcctggccgacgacatgggcctgggcaagacggtgcagacgctgtcgctgctgctgacccgcgcccatctgggtccgcagctggcggtggcgccgacctcggtggcgctgaactggctggccgagaccgcccgtttcgcgcccagcctgcgtttgcgcgcctatcatcaacaacggcgattggacgatatcgggccgggcgacctggtggtggtcagctatggcctgctgcagcgcgaggccgaggcgtttggcgacgtgcattgggcgtcggtggtgctggacgaggcgcaggcgatcaagaacccgcaaagccagcgcgcccaggtggcgcaaagcctgcgcgccgatttccgcctggcagccagcggcacgccggtggaaaaccacctgggcgagttgtggagcctgttccgcttcatcgcgccgggtttgctcggcaacctggcgcagttcgagcagcgctacgcccagccgatcgccgacggcgacgaggccgcccgcgcgcagctgaaggcgttgatccagccctatctcttgcgccgcaccaagcgcgaggtgctgaccgagctgccgccgaagaccgagaccacgcggctgatcgagttgtccgagccggagcgccacgtctacgaggcgatgcggcaggaggccttggcccgcgtggccgaggctgatcccgcagccggcggccagcccatgcaggcgctggccgagctgacccggctgcggcgcttctgctgccatcccaagctggtacagccggacagcgcgctgccggccagcaagctggcggccttcgccgacatttgcgaggaactgctggacaacggccacaaggcgctggtgttcagccagttcgtcgatcatctggcgctggcggccgagcacctgcggcagcaaggcgtccgcttccattatctggatggcagcacgccgaccaagcagcgcaaggccagcatggacgccttccaggccggcgacggcgatctgttcctgatcagcctgaaagccggcggcaccggcctcaacctgacggccgccgattacgtgattcatctggatccgtggtggaacccggcggtggaggaccaggcgtccgaccgcgcctaccggatgggccagcggcggccggtgacggtgtaccggctggtggcggccggcaccatcgaagagaaaatcgtcgaattgcaccgcgacaaacgggccttggccgacagcctgctggccggcgccgacatcagcgcccggctggacggcgaggccttgctggcgctgctgcgcggcgatgccggctagggggggccggcggcagcgcttccccatcgtcggctatcctgcccgccccgccggtgccggcagattggcggccggtgccggcgcgccgccctggcgcgtcgccagccaggcccccaggctgacgcagaccaggccggcggccaggtagccggtcagcggctcgcccaggatgggcaccgccagcaggccggccagcaggggaatcagcgcgaacaaggcgctgacgcgcaccgtgcctaggatggcgctggcgcgcagatacagcagcatggcgccgatggcggcgcccgcgccctggtacagcgcctggaaggccagcatgccccaggaggcctcggccaggtgcttgggcaggagcagcgcgtagatcggcaggtagatcagcgccgccaggatggtgatggcgcgcgtcagcggccagggctggaagccccagcgccgcgccagcacgccgaagctggcccagcagagcgaggacagcagcaatagcacgtcgccgggcagggtatggccgccggcgtcgccgaacatcggcgccgcgctgatcgccaggcccagcgcgatcagcgcgtagcccggcagcttgtgccgctgcacagcctcgccggccagcagccaggcgaacgccgccgacaggaatggctgcaggccgggcagcagcaagccgccgtgcgccgccggcgcgtatttgaagccgcaataggcgaaaacgctgacgccgaggccgcccagcagggcgagcagccactgcctggggtcgcggacggcgccgcgcggcaggccgccgtaggccagcaggatcagcgcggcagtgccgacgcgcagcgccaggatgtcggtgccggccagcgcgcttttgcccgccaggcgggagacgatgttgaagccggtccagatggcgacggcgccggcggctgccagataaccctggcgggaaggggaggaaggcatcatgggctcctgtgttcggatacccggatgctagtccgcttcaataatcaggaaaaatgaattattctgattaaaataatctctaggagagaatgatggagctggacgagttgcgcattttccaggccgtgctgcaagaaggcggcatcacccgcgccgcgcagcggttgaaccgggtgcagtccaatgtcaccacccggctgcgccagctggaagacaagctgggagtggaactgtttctgcgcgaaggcaagcgcctgctgcccaccgacgccgcccaccgcctgggcggctacgccgagcgcctgctggcgctggccgaggaggcgcgccaggcgatgcaggaccagaccccgcgcggccaattgcggctgggcgcgatggaaagcaccgccgccgcgcggctggcgccgctgctggccgactaccatcactgtcatccggaagtgcggctggagctgcaggcgggagagtcgcgcgcgctgctgcacgcggtgctggacggcaagctggacgcggcgctggtcagcggtccggtcgacgacgacaggctggagcagacggcggcgttcgaggaagaaatcgtgctggtggcggcggccggcctggcgcagctgtcattgcacttcctggccgactccacgctgctgaccttcggcagcggctgcgcctaccgccagcggctggaacactggctgaggcgccagggcgtgcagccgcggcgcatcgtggagctgacttcctaccacgcgatgctcagctgcgtggccagcggcatggggctggcgatggtgccgcgcagcctgctggactgcatgccgcaggtggccggacaggtgtcggtgcatgcgctgccggccgacctgagccaggcgcggacggtgctgatccgccgccgccagtggcgccagccggcgctggacgcgttgcagcggatgctgcaggaaaaataccaatcgcctaagccagttgaggaatttccatttatttcaaatagtttgtaataagaagttatttattaaaattattttcatattaaagcatttatctgaatttcatattcctcccgtatgatgcgcggcgctgcgatgaggcagccatagaacaacagaaatcatccgggagaaaacatgaagaagacgatcgcgctgctgctggccgcgggctgcgccgccagcagcgccgaggcgctggcctggggccaggagggccaccgcgtcaccggctacatcgcccagcagctgctgagcgcgccggccaaggcggcggtggacaagctgattcccaacgccgatttcgcccagctggcgctgtacatggaccagcacaagcaggagttgaagcagactctgccgggttccgaccagtggcactacaacgacgagccggtgtgcgccggcgtgaccgaagacgagtgcccggacggcaattgcgcggccaaccagatcgagcgctaccgccaggtgctggccgacaaatccgccgccaaggccgaccgcgcgcaggcgctgactttcctgatccacatggtcggcgacatccaccagcctttgcatgccgccgacaacctggaccgcggcggcaacgacttcaaggtgcagctgccgggcagcaagaaggtcagcaatctgcacgcggtatgggacaccgcgctggtgcagcagcagttgaacggcgccaatgaaaagacctgggccgccgccgatttgcagcgctatcaacgcaatgtcgccggctggcagagcggcggggtgatggattgggtgcatgaatccaaccagtacgcgcgcgctgacgtctacggcccgctgtccggcttcgcctgtggcgcgtcgccggccacgccggtttacctcgacaacacctatctgcgcgccggcgggctgctggtggagcagcagctggccaaggccggcgcccgcatcgccgcggtgatcaaccaggcgctgaactgagcgcgcgcccggctccccgctggcaggcggcgggccgggccatctgacgccgcgcatttccgcgctggccgctatgcactaagatgacggcctcaggaggaaatatgtcgctcaatctcgccgatgtccgattggaatactcgaagaaggaattgtcgccggaagactgcctgccggatgcgatggcgcagttcgaggtgtggctgaacgaggcgctgaccgcccaggtgccggagccgaccgcgatgaacgtggcctcggtgggcgccgacggccgtccggcctcgcgcatcgtgctgctcaagggcgtggagaacggccaattgctgttctacaccaattatctcagccgcaagggccagcaactggaccacaacccgcatgtggcgctggcctttttctggccggagctggagcgccaggtccggattgagggcacggtggcgcgggtggcggcggaggtgtcggacgcctatttcgccagccggccgtacaccagtcgcctgggcgcctgggccagcgagcagagcagcgaaatcgcctccaaggcggtgctggtcacccgggcggcgatgttcggcgcgcgccaccccatcaatgtgccgcgcccgccgcactggggcggctacgcggtgacgccggagcggatcgagttctggcagggccggcccagccgcctgcacgaccgcgtggtgtacacgctgcaagacggcggcggctggcagcgctcccgcctggcgccctgacttctccccttccccagatatcccgcgcgggccggttttccggcccgtcttcgtatccggcggccgcttcaaagacaattgtcatgtttttacaacaaatgttcggcaataagaacaatctggaattatatcgttaattttcatttttccagatggcctctgcagcacagaaacctagccacagcaattgatccagtacaggcaagcatcctagacccatctgcaactgctagaaagtacagatgaatgtggcgaagaaaattccaatacataatttatgcacttgggattgaatgagccaggatactgccagcagcatccttcctgtttgcgactacctggcagggtgtcgcggcggatccctccttcccggtgctagccgcagacgcgccccggattcttttccctgggtggcgagcctggcagcagggcgatgcgcacgactcccgcaagaggcgtcggcgaccatacaccgcccgggcggcccaggttctcccttcgtcgcgccgcttgtccggcgcagtgacgacaacccgtccaggacccgcgcttcggctcagttgccgccggccatcagctggcggcgtcgcgcgggacgcaccccgtcccgccttgcctacatttggagtccgtgatgagaaaacagcaattgatgttgcgtggtttggtcctgtccgccctggctgtgttcagctcggcggcgctggcggccgagcgtatcgacctggaaaagctgggcaagatccaggccaacggcgcggtggcgttcaccggcgtgaaccaggctgatctgaagcccctgcgcagcacccaattcgccaccggcaaagtggtgacccgcttccagcagtactaccagggcgtgccggtatggggcgaagccgtggtcgaggaaaaacaggccggcgccgtggccaagaccagcggcaaactatccggccaatacatcgccggcatccagtccgacctggcttccgccaagccgacgttgagcagcgcccaggcgttgagccaggccaaatcgctgaaggccaacggcaatcccacctacaacgagaaagccgacctagtggtgcgcctgaacgagcgcaacaccgcccagctggtctacctagtgtccttcgtggtcgacggcaaggagcccagccgcccgcacctgatcatcgacgccaacaacggccaggtgctgaagcagtgggaaggcctgaaccacgccgaagccaacggccccggcggcaacgccaagaccggcaagtatgtctacggcaccgactacggtccgctgatcgtcaccagcgattgcaagatggatagcggcaacgtcgccaccgtcaacctcaacggcggcaccagcggcaccaccccgtacaagttcgcctgcccgaccaacacctacaaagcgatcaacggcgcttactcgccgctgaacgacgcgcactacttcggcaacgtggtgttcaacctgtacaaggactggttcaacctgaagccgatcaaccagaagctgctgatgaaggtgcactacagccgcaactacgaaaacgcgttctgggacggcaccgcgatgaccttcggcgacggcgccagcaccttctacccgctggtgtcgctggacgtgtccgcgcatgaagtcagccacggcttcaccgagcagaactccggcctggtctacgacggccagtccggcggcatcaacgaggcattctccgacatggccggcgaagccgccgagtactacatgaagggcaagaacgacttcctggtgggcgcggaaatcttcaagaagaccggcgcgctgcgctacttcgccgatccgaccaaggacggccaatcgatcggcaacgccaaggactactacgacggcctggacgtgcactattccagcggcgtgtacaacaaggccttttacctgatcgccaccagcccgaactggaacacccgcaaggcgtttgaagtgttcgtcgacgccaaccggctgtactggaccgccaacgccacctacaacagcgccgcttgcggcgtggtcaaggcggccgacgcccgcggctacaacagcgccgacgtcaccaaggccttcaccgcagtcggcgtgacttgcaaataagccgccgcccgcggcagggcggccccgttcggggccgccgccaaaatagccgtaccggcgccgagaggcgccggccctcgctcgggagtcccattatgttgaaactgcgtcaaagcgctctgctggtcctgctgggcctggccggcgccgcccaggcccagccggtctggatttcggtaggcgatcaaggctatcagctgctgcgcaagatcgatgccggcgccaagagccaggaaagccgcaagctggcggccgacggccgcctcgccaagggcgccgccgccggcgaaaccgtgcacctggtgcaggtggacgacgcgctgctgccccagctgtccgacgccatccatgaaaacctgcgccactgcggcggcttcatcgtccacggcagcctgaaggaggcgcgcgccgcgctgaacggcccggccgcgccgctggccgccctcgccgcgccgagctatgcgatagacaaccaggccacggtgaacaagctgctgccgcagctgcaggacagcaacatcctcggcaccatccagtcgctgtcgggctaccagaaccgcttctacaccaccagccacggcgtcaacgcctccaactggatcgccagccaatggaagcaactggccggcagccgcagcgacgtgacggtagagcagttcagccacgccggctggccgcagaaatcggtgatcctcaccatcaagggcaccgacaacgccgccgaaaccctggtgctgggcggccacctggactccacggtcggcaacggcaccggcgaaaacagccgcgcgcccggcgccgacgacgacgcttccggcgtggccagcctgaccgaggtggcgcgcgtgctgctggccagcaactaccagccgcgccgcaccatcaagttcatggcctactcggcggaagaagtcggcctgcgcggctcgtccgacatcgccaagcgcttcaagcagcagcaggtcaaggtggtgggcgcgttgcagctggacatgaccaactaccagggcgacgcgcaggacatcttcctgttcaccgactacaccaacgccgcgcagaacaccttcctggctaacctggccaaggtttatctgcccaacttgaaggtggcttacagccagtgcggctacgcttgctccgaccacgcctcgtggaacgcgcaaggctatgcggcgtcgttcccgttcgagtccagcttcaacaactccaacccctacatccacagcggcagcgacacgctggccagctccggcaaccaggcgcgccacgcgcttaagttttcgcagctggcgctggcctacgcggtggagctgggcagcgacggtccgtctgccaaggcggcgagtctgcgctgagcgcttctccgtccgggcgcgagccagccatggggccggcgcccaggattcggccgcggttcccgctgtgggcgggaccgcggtcttttttcgccgctcagccggtgttgcgcaggccggcggcggtgccgttgatggtcaggtggatcgcgtgcagcgtgtcctcatcctccggctcggcgcgcagccgggccagcaagtcgatctgcagcaggcccagcgcgtccagatagggcagccgggtttccaggctgcggcgcagcgtcggattggtttccagcaattcggtctggccgctgatggcgtagaaggcgtcgtgggttttctgccattccgcctctatcatgccgaacagccgctgcgcgagcgcggggtccgccaccaggccggcgaagcggcgcgcgatgcccagatcggccttggccagcacctgttccatattggacagcatcacctggaagaacggcgaatggcggtacaggctttgcagccgcgccagcccggcgtcgccgtgcttttgcacataggcggccaccgcggagccgacgccgaaccagccgggcagcatcagccgcgattgcgaccaggaaaacacccagggaatcgcgcgcagatcggcgatggcggccaggctcttgcgcgaagccggccggctgccgatgttcagcttggcgatggcggccaccggcgtcgcctccaggaagtactgcatgaagcccggcgtctccaccagcgcgcggtaggcggcgaaggcggtggccgacagctcgtcgaaggcctggatgtcggtttcgccgccggagacatggcccaggctggcttccagcgtggccgccaccagcgcctccaggttgcggccggcgatggccgggtcggagtatttggcggtgatcacctcgccctgctcggtgatgcggatgcggccggccacgctgccggcgggctgggcgacgatggcctcgtacgacggcccgccgccgcggcccaccgagccgccgcggccgtggaacagctgcagccgcgcgccggcctcggcgaacgccttcaccagccgcgtctcggcctggtggagctgccactggctggtcaggtagccgccgtccttattgctgtcggaatagcccagcatcacctcctgcacccgcgcgcggctgtccaagagctgctggtaccagggcagcgcgaacagcgcgcgcatcaccgtttcgctgttttccaggtcggcgatggtttcgaacaagggcaccaggttgacgctggcgcgcggcgcgccgttttccagccggatcaggccggcctccttgcacagcagcgccagcgccaggatgtcgctgacgctggcgcagttggagatgatgcactggccgatggcgtcgacgccgaattcgcgctggatcgccgccgcctcgcggaagatggccagctctttctcggtggtttcgccgtagcgcaggtagggcgagaacagcagcctgggcgtcgccagttcgcgcgtcagcgcccgcacccgcgcggtttcgtccagcgcctggtactcctccaggccggcggcgctgaacagctcggccaccgcgctttcatggacggcggcgtgctggcgcaggtccagcggcatcaggaagaagccgaacacgtcgacgctgcggatcagccgcgacaggcggccctcggccagcagcgcgctgccgtgcgcgtgcagcgaatcggacagcgcggccaggtccgaagccagcgcccggtggtccgggtaaggcgcgcgctcgtcccagcggcagttcagctcgatgccgcgcagccgggcgctggcgcgcagccggccctgcatggtggccagcgcgcggcggtagggctcctcgctgcggctgaccgcgccgtccggcgagttttccgccagcgccagcaccgctgcgcttgccgtcaccagccgcgacgacatcgacagctcgcggtacaggctcttcaactcctgcagatagtattcgaacgcctgctgcgcctggcgcgtcaccgcatggcgcagcaagccggcgtcgacattggggttgccgtcgcggtcgccgcctatccagctgccgacgcggacgaaggagggcagacacggcgcctcgccccacagctggccgatttcgcgctccagccgctggtacagcgccggcagcgcttcgaagaaggccagcgggtggtaagcgacgccgttggtgatctcgtcgcgcaccgtcatcttgaagtggcggatttccgaggtttgccacagcgccaggatcgcccgcttcagtttggcctccagcgcttcgcgctcctccggcgtcaagtcggcggcgttgagctggcacaggaagcggcgcaccgcgcggtggccgtccagcacgctctggcgctgcacctcggtggggtgggcggtgaggatggcgcccacttgggcatggctgagcagctggtgcaggctgtggaagctgacgccgtcctggcgcagcttgtgcagcgcgcgcgccaggctgccctgctgcggcagcgaaccggccagctggtgggcgcggcggcggcggttgtggtgcaggtcttccgcgatgttgaacagctgagcgtacaggccgcaggcgcgcagcagcgaggcggcggcttccggcgccaactgcggcagcggatggctgcgctcgtcgccgcggcgctgggcgatggcttgcaccgcgccgtacaccaccgggccttcctgttcgttgaccacctcggacagcaaccggtccagacaggccaggtcggccctcagcggcaaatccttgtcgtgttcgctcgtcatcttgttcgtccctagttttcgacttgtcaggaatggccgccgccgcgacggccattcctcacctgtcataaccggataatcatcataagcagcttccacgccgtagtggcgacactacggcaatttccgcgtttgcgccttgatcttgctgcgtcgcaacaacaagcgcgccaagtccctgccggcgtcgtggtagaatctgcgcctgatttcacccctttcgatgggacccggtttcatggacaagatcgtcatcgccagccgcgaaagccggctggccatgtggcaggccgaacacatccaggcccgcctgcaagcgctgtatccgcacctcgcggtggaaatcctgggcatgactacccagggcgaccagatcctggaccagacgctgtccaagatcggcggcaagggcctgttcgtcaaggagctggagcaggcgctgctggatggccgcgccgacctggcggtgcactcgctgaaggatgtgccgatgacgctgccggaagggttcgagctggccgcggtgtgcgaacgcgaagacccgcgcgacgccttcgtctccaaccgcttccacagcctgtccgaattgccggccggcagcgtggtgggcacctccagcctgcggcgcgaggcgcagctgcgcgcccgcttcccgcaactgacggtgaagccgctgcgcggcaatgtgcaaacccggttgaagaagctggacgacggcgagttcgacgccatcatcctggcggccgccggcctgaagcggctgggtctggccgagcgcatccgcggcgagctggcgccgtcggagagcctgccggcggcgggccaaggcgcgctggggatcgaaatccgcgccggccgcgccgatctcatggcgcttttggcgccgctgaaccacccggccacccgcgcctgcaccgccgccgagcgcgcgttggccaaggagttgggcggcagctgccaggtgccgctgggcgctttcgctactctgaatgagggcacgctgacgctgggcggcctggtcgcgcatccggacggctcggtggtgctgaccgccagcgctagcgcgccggccgactacgccgaggcgctgggccgggcggtggcgaagaaactggtggacgacggcgccaagccgctgatcgcggcggtgttggccgaaccgcgctgagggcggaaccacggcattcaaacggaggggctggcatggagcactgcatcgcactgatacgcggcatcaatgtcggcaaggccaagcgcatcgcgatggccgatctgcgccagctggccgccgacctcggcggccaggacgcggtcaccctgctcaatagcggcaacctgttgtgccgctacccgtcgccggccaggctggccgccgatctcgaggccggcatcgccggccgtttcggcttctctgcgcgggtcatcgcgctgggcgccgacctcctgcccgccatcatcgcggaaaacccgctgcgcgacatcgccagcaatccctcccgcttgctggtggccttcagctccgcgccggcgtcgctggcggcctgccgcgatctgaccgagcggcagaccggcaccgagcgcctggcgctgggcaatcacgccgcgtatttctggagcgcggacagcatactcgacagcaagctgctgcaagctttcagccagcgcaccggcgacagcgtcaccacccgcaactgggcgacggtgctcaagctgcaacaggcgctggcgcgatgacgcgcgtcctggtggccaggccgcggagccaggccgccggcctgctcgcgcgcctgcgcgccgagggctggcaggccgggcatctgccgctgctggagctggcgccgctggccgccggcctggcggcattgccggcccaggccgccggcgcggacgcgctgttctgggtcagccccggcgccatcgacatcggctggccggcgctggcgggacagaatctggccggcaagcggctggcctgcgtcggcgctgccagcgccgagcggctgcgggcgctcagcggcctgccggtgctgcatccgcgcgacggcagcgacagcgaagccttgctggccctgccggagctggccgaagtgcggggccagcgctggttgatcgtccgcggcgaaggcggcagggcgctgctggcgcagaccttggccgcgcgcggcgcggcggtggcgctggccgagatctaccgccggctgcccggcgcgcccgactgggacgacttcgacgccgcgccgccggatgccgtcgtcctcacttcaggcgaaatggtagagcaattgttccgactggctggcccgagccgggcggggacgctacaatgcctgctatattgcgtgccgcatccgcgcatcgccgagcgcctggccgcgttcggcgcgacacgcatcgtgacaacccgggccgacgatgccgcactggtcgccggcctcaaagaatggttccgtcgtcacccatgagcgaatcccagatcaacgaagccatccaggcgccagcgcgcccggcccgcaaacgccccggcctcgcgctgtggctggccgccgccgccctaggcgtcgccggctggcagttctactccacccagcagcagctggactccatgcgccaggaactggcgcgccgcctggctgaaggcagcggcgccggcaaggagcagcgcgccatcgccgagcaggcgatgctggcggcgcgcgccaccgacggcaagctggcgctggtggaggcgcgcgtcaacgaggccgccggccagtacgcgaccctcaacggcatgtaccaggagctgaccaagaaccgcaccgactggctgctgtccgagatcgagcacacgctggccatcgccagccagcagctgcagctggccggcaacgtgtcggcggcggtgtcggcgctggagatggtcgacgcccgcctcgccaagttcgaccggccgcagctgataggcgtgaagaaggcggtggccaccgatctggaaaaattgaaggcgctgccctatctggacagcgtcggcctcaccgtcaagatcgaccgcctgatgctgggggtggactcgctgccgttggtggtggacgcgcatcgcctgggcggagcccgcggcgcgcatccggcggcgctgccggccactgcgccgtggtgggagcggctgtcggctgagatcagcgccagcctgggcgagctgatccacatccgccggatggacaagccggaggcgttgctgctgtcgccggagcaggccttcttcctgcgcgaaaacctgaagatgcgcctgctggacgcgcgcctggcgctgttgcagcgcgacggcaagacctacgccgccgacgtcgccgccgcgcgcagctacgtgcagcgctatttcgaccgcgacgccgccgccaccgtccagtggctggcgacgctgggcgagctggaaggcgcgcctctggacatcagcttgccggacatggcctccagcctgaaggcggtgcgcgatgcccagggcgccagcggggagtaaacggtgagattcgcattgtggattaccggcctgttcgcgctggccgtgctggtggggctggcctccaccctgaataccggctacgccatcctgtttttgccgccgtaccggatggaagtgtcgttcaacctgatgatcgtgctggtgatcgcgctgatcgtcgccacccacctcgtcttgcgcctggtcgcgctggccaccgacctgccgcgccaggtgcagcgcttccagcgccagaaaaagttgaaagccgcccgccacgcgctgcgcgaagccggcatcgccttcttcgagggccgcttccagaaggccgagcgcgaggccgccaagtcgctgggcgacgagtacgcgccggagaaccgggcgctggccttgctgatcgccgcccgctccgccagcgcggccggcgcaggcgacaagcgagacgactacctgggacagctggaccaactgccggagcgcctgcagctggcgcgccacatgctggacgccgagctgaagctggaagacaaggacgcgttgggcgcgctggccgccatcgagcgcgcgcgcgcgctgtcgccgaatctgaccaacgcgctgcggctggaattgaaggtgcggttgctgcagaagcagcccgaggccatcctcagcttgaccgaaaagctgctgaaggccgacgcggtcgagccggagcaggcgcgccgctaccgcttggctgcctaccagcagcagctggccggcatgctgagcgagcgcgaggtgcgcgagtggctgcgccgcatcccggaagccgagcgcggcaacccgcagctgctgcagcaggtggtcaagcatctgatcaagctgcagcagtacgactacgccgccaccttgctggccggcgcgctggccagcgacgaaatggagctgccggaactgtcgcgcgaactgggccagctggccagccatctgagcgtggagaagcggctggagctgctgaaggacgcggagaattggctgaagctgcggccgcgcgaccactggctgctgctggcgctggggcgcctggcgcaagcgcagcaattgtggggcaaggcgcagaactatctggaagccagcgtttccatccagcccacgctgtgcgcgcatgccgaattggggcggctgttcgaggccaccggcaaggaggagctgtcgcagcagcattaccagaagagcctggaaatggcgctgaaccagggctattgatcccttccgggcattgccgcgatgccgcccgcctgattggctggcggcatttttcatggcggatcgaggcggcgcggcaaaaaaaatcggactccgcggggagcccgttcatgccaacgtggactggcaacaacaaatcgatacgagagtgcggacagacatcctgtcagacaataaggatgccgagcggcgaaagctgtgccagaatcaaccattatgcatggttggcgtgagccctatgcataccggctgccgtcgccatgtcgccgcagcctgcggcaacactcgtcccagcatacgtggtggcgcggttttgcacaaagcagttaatctcatgaaaactatgaagaaaaggcatgtaacagcatgaagctgcctccgctgaatgccctgcgcgtgtttgtcgtcgccgccgaacacctgtcgttcacccgcgccgcggccgcgctaagcctgacccagggcgcgatcagccgccatgtgcaaacattggaagagtactacggcgccacgcttttcacccgccaggcccgcggcctggcgctgaccgccgagggcgaggcgctgctgaagccggcgcgcgaagccttccagctgctcaacgaggcgagcgaggcgttgcgcttgcgccagagcgacctgcgggtgcggatgccgccgacgccggcgatgcgctgggtgctgcccaacctggccgatttccaggcgcgccacccggagtacacgctgcatctgctgacccagctgatccacaacaagccgttcaaccgcgccgagtacgacctggcggtggtcgggctgtccagcccggaggccgccgccgatctcaggctggaatgcatctgccgcgaaaagctgatcccagtgtgctcgcccagcctgctggccggcaagcatccgctgcacaccccgcaagatctcaagcaccacacgctgctgcacccatggcgcgaccagaacacctggaagcgctggctgaagctggccggcgtttccggcgtcaacccggagagcggcgtcactttcgacgcgctggaatacgcgctgcacgcggcggtgaccggcatgggcgtcacgctggcgcaggcatcgatggtgacccaggacctggacagcggccggctggtgattccgttcgacaccgtgctggaaaccgagtgggcctactacctggtctacccgcacgaactggccgagctgcccaaggtgcgcgccttccgcgactggctggtgggcaccgtcgcccgcagcgaggaagccagctggctgacccgccagggatactgagcgcccgtcacatttcttaaccatcgcggtttggacagcccggcggctgttcggcaaaatgattgacatagcaactattgccttgtcaatcatgaatgccccctctccttctcccgccgacatccaggcgctggatttccgccagcgcctgctggcgatgctgggcctgtgctgcgtgctgatcatggtggcgctggaccagaccgtggtcggcaccgcgatgccgacggtggtggccgacctgcgcggtttcgcgctgtatgcctgggtcggcaccgcctacctgctgacctcggttatcaccgtgcccatcttcggcaagctgggcgatgaccacggccgcaagcccttcgtgctgaccgccatcgtgctgttcaccgcggcctcggcgctgtgcggcctggcgcaggacatgctgcagctggtgctggcgcgcgcgctgcagggcgtcggcggcggcatgctggtggccaccaccttcgccagcgtgcccgacctgttcccgcatacccgcgaacgcttgcgctggcaggtgatgctgtcggcgtcgttcggcctggccaacgccatcggcccgtcgctgggcggcttcctcaccgaatacctgggctggcgctgggtatttttcgtcaatttgccggtcggcgcggtcagcctgtggttcgtctggcgctacctgccggtgatccgccatgccgcccaggcgccgtccaggctggactggcagggcgcggtgttgatcgcgctgttcctcggctccctgcagctggcggtggagtggctgccgcagcacaagtcgccgtggctgctggcgctgctggccgcgttgagcctggcttcgctcgcggcgctgatctggtgggaaaaacgcagccccaaccccttgctgccgcccagcatgctggcgcatccgggcctcgcgccgctgttcggtctgtcgctgctgatgggcttcggcatgttcgcggtgatgtattacgcgcccttgatgttccaggccggcttcggcctgtcgcccaaccacgccggcatcctggtgacgccgctggtggtgttcatcaccataggcagcatgctcaacggccgcatcgtgcagcgcttgcgccgccccacccggctgctgagcgtcggcttgctgatgttcgcgctgacggcggcgctgctcagccaggccggcccggccaccgcccactggctgatcatcgccaatatggtgatgggcggcctgggcctgggcctgctgatgcccaatctgaccatcttcgtccagcagctggcgccgcgccggcagctgggggtgtcgaccgccatgctgcaatcgacgcggatggtgggcggcatgctgggcaccgccgtgatgggcgcggtggtcagccaccagttccagctgggcgtggcgggcatgctggcggccggccacgcgcaagcctggctgcactggctgggcgatccgcaaaccctgctcaacgccgacagcctggcgcagttccgccatgccgccgccgcggccgatccggagcggctactggccgccacccgccagttgctggtggacgccatccatgtcagccagtggctggtggccggcggcctgctgctgggcctgtggctggtgcgcaaggtgccggccatcaccctgtcgtccgccgccgcgccgcgggagccgcaacatgactgaaaccacgcccaatctgttgcagcagctgggccgcagcagccgcgccatgtacggcgccttcgaaagccgggtcggccacgcgctgccgcgctggcgcatcctgaaatcgctggaggagctggaagtggccagccagaggcagctggcctgccatttgcagatggacccgggcgcgttgacccgccagctgaagctgctggaggccgacaagctggtgcggcgcgacaccgacccgtccgacaatcgccagatccgggtgacgctggacgaggccggccgcgcgctgctgctggcggccgcgccgcagcggcaggccttcttcgcccaggcgctggacgggatagacgcggagcggctggcgacggcgctggaggtgctgcggcagctggaggcgcgctttcgcgcgatgtccgccgcgggcgcggactagcctgtggagcggtcctgctcgtcgtcggcgatcaccatccggttgcgcccctgctgcttggcgcggtacagctggcggtcggccgcctccaccagctggcggctgtccggggtttcgcgcggcagcaccgcggcgccgccgatgctgatggtgacgatggcggaaatcgccgagccgacatggggcagctgcaggtcgcgcaccgcttccagcaccgcctcgccgacgcaggccaccccctcctcggtggtgtccggcagcaggcagacgatctcctcgccgccgtagcgcgccaccaggtcctgcggccgccgcacgctgctgcggatggcctgcgccacttcgcgcaggcagtagtcgccgctgacgtggccgtagtggtcgttgtatagcttgaagtagtcgatgtctatcatcagcatgccgagcgaggtgcccagccggcgcgcgcgccgccactcgccgtccaggctttcctcgaagctgcggcggttggcgatgccggtcaccgggtccacccgcgacagtgccagcacttcggcgtgcgactgttccagcgccagcgtgcggatgcgcacctgttgctccagctgttcctgctggcgccccagctccagcttgatccggcgctgctcgctcatcagcgcgcccacgcatagcgacaccacggtcaggatgccgacataggtctgcacgatgatcagcgtgctgtaggcggaatagcccaagtaggggccgccgccgtggcgggtgccccacagcgccagcgccatgatcagcagcagcgccagcaccacctcgcgcggggtgaagcggaacgccgcccacgccaccagcggcagcaccagcaggtccagcggataggtggtgtccatggtcgggtgccaccagacgaagatgctggcggtcagcagcgtcaccatgccgaaataggccagcatctcgtaccaggtttcgcgctccacccgcggccagccatgctggtgcaggatcaggaaggcgctgccgaacagcagcacgccgcagccggcgctcagccagcgcagacagcattccatcaccagcagcttttgcggcagcaggccgcacaggtacaggctggcgacggcgatcagcgcgcccagcagcgtcatcgccgccacgatgacgaaatacagcaggcaatggctgaagctgtccagcgggttgccgcggccgatatggcgccgcaccagccaggcgcccagcagcgtttgcgccagcacgccggcggcgatgccgctggccggcttcagccagcctatgcccgccaccagcccatgccactgccagccttcggccagcaaggcccccagcagcaccccaggccagacccgccagcccagcagcagcaccgccgccagcgccaggccaggctgcggccacaccacgctgtccatctccagctccagcatcagccagtggtcgcccagccaggcggacgcgaaatacagcgccgccaccagcgcgcaattcagccagttggggaatgcaggaatagcggaaaggatgccgcgcatgtagtgccctctgcgaacagaccgcggccgcggtccagcgggccagccgggtggcgttggataccaggactgcgccctactgtcatcgtagttggcgaagccggccgacgcagccagaaaaaaagccgaagcatggcttcggcctgttttcgcgtccacgcgggcgggcggattacatcttcacgcccagctcgcgcaagcgttcgtccaggtagctgccggcgctgtggcggtcggacagcaccacttccgggcgcgggtgcaggaacagcggcagcgagacgcggctcttcttcgcgccctcgccggtggggttgaccacgcggtgctgggtggatgggtagaagccggcggaggcttcctgcagcatgtcgccgatgttgaccaccagggtgccgaagtcgcagggcacgtcgatccagtcgccgttcttgtcctgcacctgcaggcccggctcgttggcggccggcaggatggtcagcaggttgatgtcgccgtgggcggcggcgcgcagcgagccggccggctcctcgccggtcagcggcgggtagcgcagcacgcgcagcagcgtctgctggctgtctgcgatcatatgcgacagcggttcgcggtagttggcggcgatggcggccggggtgtactgctgcacccaggacagcagctcctgcgccagctggttggcgatggcgtagtagcggtcggcgtcggccttcagcgcggccggcacgcggccccacgggtagatgtggaagtattccttgatgtccttgagcgtggcgcccttggcggtttccgacacttccggcgagaaccagccgtcctgcttctccatcgagaaggcgtagtcgaacttctcctcgctgttgaagaaggccagccattcggcgtagatcttctcgaccaggtcttgcgggatggggtggttggtcagcacgccgaagccggtttcgtgcagagaacgggtgaactgttccgcggcgtccggggcgcggtaatcgacaactctgacgttcatggggcggttttcctgatgaacccggcgccgccatgcaatatcggggcggtcgccggccgcgcgcattgtaacggctaaattacaggcggccaagccgacggcatgccgactgttggaaaaccgcccggcgccggcgcgcttgcgcggcaatggaaattcagcgttttccggcagggttgccatggcggatcggcgcgccgcgccaggcgggccgcggctgggcatggcggcgaaacgctgtatttaaattacagcgccgccgccggacggcgtcagacccgctggtccatgtccagcgccggcgtgccgggacaagcttgcgccaccacccgcgccggcacgccggccacggtggcgtgcggcggcacgtcttccagcaccacgctgccggcgccgaccttcgcgcattccccgaccaggatattgcccagcaccgccgcgccggcgcccagcatcacgccgtcgcctatcttgggatggcggtcgccgcgctccttgccggagccgcccagcgtcacgccgtgcaggatcgagacgttgttgcctatcaccgcggtttcgcccaccaccaggccggtgccgtggtccagcatcacgccctggccgacgcgggcggcggggtggatgtcggcgccggtcacttccgagatgcggttttgcaggaacagcgccagcgtgcgtctgtcctgctgccacagccagtgggtgatgcgctggctctggatggcgtggaagcccttgaagtacagcagcggcgtggaatagctgtcgcaggccgggtcgcgctcataacaggcgcgaatgtcggcgcgcatcgcggcgctgacggcgggatcggcctggaacgcttcgcggaacaattccagcagcgcgcgcggatccatcaccgggctggcgagcttgctggacaaatggaaggccagcacgtcttccagcgtggcgtggcgcagaacggtcatgtgcaggaaactggccagcagcggttcgtcgttgaccgcggccagggtttcatcgcggatggccgaccacagcggatcaaccagagaggcactcatcggggactccagggggcaatagcaactagtcgaaacattgtagcctgccgcgcgccgggccgggagaacaacatcatcatcggcaaggccgtcagaatcggccgccgccggcgactaatctgcaaatgcggggaggaaacgcgatgacacggtttgcggcggtgttgctggcgggatgggtcagcctgggcgcgctggccacgccgcccgatgtgccgggctggcgcgaataccaggacgggcggctggcggccgcccgcatcgccttctggcaggcggcggaaggcggcgaccgggtggcggccttcaatctggcgatgatggactggcgcggcgaggccggcaaggtggacaagccccaggccttgtactggctgcgccgggcggccgacggccagctggcgcaggcgcagtacgcgctgggcctgctgtacgaaaagggcgacgcggtggacaagtcgctgaccgaggcgacgcgctggttcgcgctggcggcgcgccagggctatctggccgcccagatcgaccttggcacccagtattttctcggccgcggcgcgccgcaggacgacaggctggccgcctactggtacgaggaggccgccaagcagggcgacgtgggcgcgcagtacctgatcgccagcatgtacgagcgcggcgagggcgtgcagcgggacatccccgccgccatccgctggtacgccaaggcggcggcgcagggcgacgtcggcgcccgcgccaaggcgctggacctggccaagacgctggcccgccactgatcgcggcgcgtcacagcgcgtccagcggcagcttcagatagcgcacgccgttgtcctcgggcggcggcaggcggccggcgcggatattgacctgcaccgccggcagcagcagctgcggcatcgccagcgtggcgtcgcgcgcctcgcgcatcgccacgaaatcggcctcttccacgccgtcgcgcgcatgcaggttggcgcggcgctgttccgccaccgtcgcgcaccaggccggcgcgcggccggcgggcggatagtcgtggcacatcagcagccgggtgtcgtccggcagcgccagcaggcggcggatggagcggtacagcgtggcggcgtcgccgccgggaaagtcgcagcgggcggtgccgacgtccggcatgaacagcgtgtcgccgacgaagaccgcgtcgcctacttggtaggcgatgtcggccggcgtgtggcccggcacccacagcgcggtggcttccagcgcgccgatgcggaaggtttcgccgtcgccgaacaggtggtcgaactgcgagccgtcgctgcggaacgccggctccaggttaaatacccggcagaaagcgtcctgcacctgggtgatgcgctcgccgatggcgatgcggccgccggcctgctgttgcagatagggggcggccgacaggtggtcggcgtgggcgtgggtttccagtatccattgcagcgtcagccgccgggcgcgcaggcattccagcagccggtcggcggagcggcgcgaggtgcggccggacttggggtcgaagtccagcaccgggtccaccgccgccgcatggccgccgtcccggtcatagaccacgtggctgacggtgccggtggcggcgtcgtaaaagctttcgatctgcgcgggcatggtgtcctctgtcggggcggtgctttacatcattatataaattaatataatgatcggcagtatattctcaggcgcctctccatgcaatcccggcttgtcattgtcattatttttatcggggcgcggccatgctgctgatgctgcttctgggcgcgctggtcggcgcggtgctgggcctgaccggcgccggcggcggcattctggccgttcccgcgctgatggccgcccaaggctggagcttgccgcaggcggcgccggtggccttgctggcggtggccgcgggcgcggcgctaggcgcttacgaaggctggcgccggcaattggtgcgttatcgcgccgctgcctggatggcggccagcggcgtgccgttcgcggcggcgggcgcgcgcgtcgcccacctgttgccggcgccgctgctgtcgacgctgttcgcgctggcgatgctgatcgtggcggcgcgttcctggcgcacggccggcggcgcggcaactcgcgatggacgcgccgcgccttgccggctggacccggagaccggccggctgcgctggagtccggccgcggcggcggcgctcgcgggcgtcggcgcggtcaccggttttctcaccggcttgttgggagtgggcggcggcttcgtcatcgtgccggccttgcgccggctcagcgatttgtccatgcacgccatcgtcgccacttctttgctggcgatagcgctggtgggctgcggcggcgtgctggcggcgctgtggcacggaacgcgggtgcccgcgctgcccagcgccgtgttcgtgctggcggcgataggcggcatgctgctgggccggcgcctgatccgccgcctgtcgccgccgcaggtgctgcgcggcttcgccgcgctgacggtggcggtggccgccgtggtgctgtggcgggcctggggcggctgaggcgcgtcagatataggcttcctcgccatgcagcgtggcatcgaggccggcctgctggacggcggcgtccaccttgaccggcgtgacccggtctatcagccacagcatgccgtaggtgaaggcgaacgcccacacgcccgacaacagcgccgcggcggcctgtttccacagaaagcccgggttgcccagcagcaggccgtcggcgccggcggcgttccaggccttgctggcgaacacgcccagcagaatggtgccgagcaggccgccgacgccgtgcacgccccagacatccagcgcgtcgtcccattgcaggcggttcttcaattgcacggcgaagtagcacaccgcggcggcgatcaggccgatgacggcggcgctgcccagcgacacatagccggcggccggggtgatggtggccaggccggccaccgcgccggtcagcaggccgacgaatttgggctgtttggcgtgcgcccactccagcaggaaccaggcggtgccggcgaaggaggcggcgacgtcggtgttgaggaaggcggaagcggtgaccgcgtctaccttcaattcagagccggcgttgaagccataccaaccgaaccacaacaggccggtgcccagcgcgatcagcggcacgttgtgcggcttgttttccaccagcgagcggcggccgacatacaggatggacgccagcgcggcgaagccggcggtgttgtgcaccacgatgccgccggcgaagtccagcacgccccacttggccagcaggccgtcaggactccacaccatgtggacgaaggggaaatagaccagcaccagccagccggtgaggaacaggaagtaggctttcaccgtcacccggttggcgaaggcgccggtgatcagcgccggcgtgatgatggcgaacatcatctggtaggcgatatggaccaccagcggaatgccggcgtcgttgccggcgtacatgctttgcagcgtgacgccgcgcaggaaggcgtaatgggtcgggtcgccgacgatgccgtgccagctggggccgaagcacatcgaatagccgaaggcgaaccacagcaccgtggtccagcccagcgacatgaagctctgggccatgatggtgagcacgttcttgcggccgaccaggccgccgtagaaaaaggccaggccaggggtcatcagcatcaccaggctggcgcacagcagcatgaagccggtgttgccgatgttgagcggaatcgcgggggaatgcatggttttatcctcatccagaatttatgtattagtaaattatgtatgacggatattgcgccccatccccggccggctttcttgcaccagatcaatccattaacaatccatttacaaatcgcaacactttcgctgcgcatttgggccgcaaaaaaagccgccaggatcatggcggcttgcgcggcgcggctggccggcctcagtcgccgaagccgaacgcctcgccgctgccggcgcggatggcttcggccagcgtggcgaagaactcggagccgtcgcggctggcgatccaggccgcgccctggcgggagaagtggtagccgccgcttttcgccgcgatccacaactcctggttgacggcgtggcggttgacgatcactttttcgccgctgtcgaactcgatttccagcacattgccctggcgcagggtatcggcatccaggccatggtcgtcgatggccgcttcgatctggtcgaagatggcgtcgctcagttgcagaaattcgctttcggtcatgatggtttcctgtgtggccggccggacgcaacacgggccggcgcggttttgctagtatgctgattttgccatatcggattgctgtcagtatgcgtaccctgctcgcttgtgcaagcctgaccctggccctggcggcctgcggttacaaaggaccgctggtgttgcccaaggcgccgccggcccacgccgtcgctccggccccgcaggcggccgcgcccgccgcggcttcggccgcccgctagccggaaggcttctttccgcgctaaggatatttccaagcaatcgcttgtctgaactcgcgttggcctagaatggccgtcgtcaccctgcgaatcggaaccgccatgccacattacgcgcgccacctggaacatcacaccatcgtcaacccgtttccgggcatcgccaagctggaggcggcgctggggcacaaggtggtcagccggctgggcgccaacgagagcatgagcaagccggagtcgccgctgctggcgcagtggggcgaggcgctggccgaactggcgcggctgtatcccgacccctacgcgctggcgctgcgcgagcgcgccgcgcaacgccacggggtggagagcagccaggtgatcttcgactgcggcgccgacagcctgatcctgctggcgctgcggctgcgctgcaacgccggcgacgcggtggtgtgcagcgccggcacctacccggccttccgctatttcgccgagggcgtgggcgcgcgcatcctggaagtgccgtatcaggcgcagggcataggcctgcggccggatctcgcgcgcctgtgcgaggtggtgcaggccgaacgcgcggtggcgctgtacctggccaatcccgacaaccccaccggccattactggtcggccgccgagatccaggcgctgcgccagcagctgccgacgcagaccatgctgatcctcgacgaggcctatgtcgatttctgccaggacccgcaggacgcgccgccggcaggggtattgcccaacaccctgcggctgcgcaccttgtccaaggcttacggcctggccgggctgcgggtgggcttcgcgctggcgccggccgacatcatcgccaaggccgaccagatccggccgcagtacgcgctgtcgggcctggcccagcacgcggcgcagctggtgctggacgacccggactacgcgcgccaactggtgcaggccacggtgcagctgcgggacaagctggaggccgcgctgcgcgcgcgcgacctcgccgtgctgccgtcgcacaccaatttcgtcagcgtgctctaccccaacgcctcctgcagcgaggcgatccagcgcaagctgctggccgaaggggtggcggtgcaccggccgccgcatccggcgttgcgccatttgctgcgggtcaccgcgcagccgcaggcgctgtctagcaaggtgctggacgcgctggccggccattgagccagacaggttgtcataattacattgacagccagcgaacccaatgacataagcgaggcggaaatcctcccgtatcgcttattgatcccatgaaaaaatccttctatcccctgctcggcctgctgctgtcggcagcgggcggcgcgctggccgcgcccatcaccaacttcgacagcgatccggtgatcgacctggccggccagctgcgtggccagcagcacgccggccgcgccgtcgcggcgcaggcgctggacgcggccgccagcgcggccatcctgcgcgaagccggcgaccgccgccagctgctggatccgatgagcatcccgaagaacgacagccgcatggtcgccgcgcatccggaattcagccgccgccagggccagttgctgaccgtgtccaccccggccggccagcgcctgcagttcaagagctggaaaatcgccaagggcgacggcgacagctccaccttcctctaccagggcccgctggccggcaacgcgctgcagcgcgtcgacctgcagttcggccatgacgcgccgggcagcctgctgatcgacaaccgcagcggcaaggtcttttttacctacagcaccgagaacatggtgtccgcgtcgcccgacggcagcgcgctgctgcagctgcagaattcgcccgactggcgcctgcagctggtgtcgctgccgaacaccgagcagggcagcctgttctgcagcctgagcgacgcttcggtggaaaccgtcttcaaatcctggcgcggcaacagcctgggcctgcagctggagaagggcggccagaagctggcgctgcgcttcagccgcaacggcggcgactggcaggtcgccgccagccagcccgcgcagctggccaagctgggcctgcgctgcagccagtcgcgctaagccagccaaccccaaagcaaaacaagcgcccctcatcgcaaggggcgcgtttaccgtgatgagcagcaaaacatgaaaaccaatcgcagttacctcctgaccgcgctgtgcctgctggcggccagccagctggcctgcgccggcaaggctatcgcggtgcgcgacgacggcgagacgccgatcacgctgcgcggcgccgtgatcgggccgatctcctccggcagcaaggccgacggcaccttcttcaaggcctaccacctgaagctggagcgggaaatgaccttcgacgacggcggcgactgcggcgagcaggccaagcgcagcctggcgctgaatcaggaaggcatgggccgctacaagggcaagaccgtgtcgctgaaggccaaggtgttctgccagctgagccgcaccggcacctaccacctcagcgacatcgtggtgcagtgaggcgcggcggcggccggtttcccgaaccttggccgccgctccgggtctaccatcgggtctttcgcccgattgcagacccgcgccgcatgccctggatccatcccgaactgattcccctgatcgccttgctggcgctttacgccgcctcgctgctgtacgcgctgcggctggcctggcgcacccgcggcctgcgctggctggcttgcgcgtcgctgttgatcgccggcttcctggcgatgctgctggcgcggccggccacgcccgactccggcgagatgccgccgggcttcggcctgggcgcgctgctggcattggccggcatcggcgccgccgccggcggggcggtctggcgcgccttgcgccgccatcggcgctgacgcaacagtcagcccttttccctgcccatgccgtggacattcgcggcgcgcgcgcctacgatggcgcaaattccggccatgccaaaggcattgccggccgcggccgcgcgcgtcggccgcccatcgcatccgaaggagccgcaaccatggatgacgccctgcgacggcgggcagtattgaagggcggcttggccgccgctggcctgctggccctgtccggcaggctgcgggcggcagcctggctgtatcagggcttcgacaacggctggcgcgagctggtgccgtatccgcagaagatgccgctgctgcgcatcaccacccggccggtgcatctggagacgccgttttcccagttcgaccgcggcctgatcacgcccaacgaggcggtgttcgtccgctaccacctggccggccacccgctggacatcgacgccgccagccataccctgacggtgaaagggctggtccggcagccgctgacgctgacgctgcgcgatctgcaaacccgtttcgaaaccgtcagccaaaccgtggtgatgcagtgcgccggcaatggccgcggcctgctgcagccccgggtgcagggcgcgcagctgggcaacggctcgatggcctgcgtcgagatgaccggggtgaggctggccgatgtgctgaaggcggctggcgtgaaggacggcgcggtgcaggtggcgttccgcggcaccgaccagccggcgctggaggagacccccagcttcatccgctcgctgtacctggaggacgcgctgcggcctgaggtgatgatagcctgggcgatgaacggccagccgctgccggtgctcaacggctatccgctgcggctggtggtgccgggtttctacgcctcgtactggatgaagcatctgtcgcagctggaggtgctcgaccacgtgttcgacggctggttcgccgccaccgcctacaccgtgccggacacgccggactacggcatcgcccccggcgccaagccggagcggacggtgcggctgacaagaatgaaggtgcgcagcttcatcacccacccggccgacggccagaccgtggcggcgccggacggccggctggctttgcgcggcatcgccttcgacggcggcagcggcatccgccgggtggaagtgtccgccgacggcggccgcagctggctgccggcgcggcttggcgaggagcgcggccgcttcgcgttccggccatggacgctgacgctggatggcgtcaagccgggcgcgctgcagctgctggcgcgcgccaccgccaacgacggccagacgcagccgctggtccagccgtggaaccccggcggctacgcccgcaacgtggcggagcgggtggcgctggtcatcggggaggccggctgatgaaacccgccctgctcgtcgcgctgcttctgctggccggcccggccggcgccgtctccatccagttgcccaacgaaaccgcgatgctgcccgacagcggccatcccggctatccgaccgcgctgcagcgctgcctgatctgccattcggccgactacatcgcgctgcagcccgacttcagccaggcgcgctggcaggccatcgtcgacaagatgcgcgccgccttcaaggcgccgatcgcgccggaggaggtggcgccgatcgccgcctatctcgccgacgcgcagcgccggcgcttgctgcagccgcggccgccggccaagccctgagcgcggcggcgggtttggcctggccgccgcctgccgttatcatcgtgggcttccgccacttttccacggagccgccatgcccctgccgccccccctgacgctggccgccttcgcgctgctggccctgggccttgtcgccgccagcctgcgccacgccgcgccgggctggatagccctggtcaccagcgcgatgctggcgctggccgccggcgtgctgcagccgctgggcgtggtggcgacggccgccgccgccggcctcacttgcagcctgcgccgctatccgcggccggagtggtacctggtgtgggtggccttgctgctggcgctggcggtgcacgcgctgcccggcttcgacaaccccttgctgtggcagggcaaggccagcgccgccagcgcgccgtaccggctgttctggagctacgacaagggcctggccggcctgttgctgctgctcaacctgtgcaatgccccgctgcccggccgcacgctgggctggccggcggcggcggtgggcggcctcgcgctgctgttcgtgctgggcatcgccgccggcttcggcatcatcggcctggcgccgaaatggccggcctggctgctgccctggctgttcgccaattgcttcctggtgtcgctggcggaggaggccttcttccgcgccggcgtccagcgctggctggaaatccgcaccgagcctttcgccgcgctgatggcggcgtccttgctgttcggcctggcgcacctggccggcggctgggcctgggcggggctggccacgctggccggcatcggctacggcctgatctacgccgcgcgccgccagctgtggctggcggtgctggcgcatgtggctttcaacaccgtgcatctgctgctgttcacctatccgaaaccggcgtgaacggcggcgatcccgggtggttatattcgctaactgtcttgatatgaaaataaaaaaccataacgggtagccggcggcatcggttaaaatcgcggtcttcgttcaccatccgcgagcagcaccgccatgattgaagtcggcatcgtgatgggtagcaacagcgactgggaagtgatgcagcacgccgcgagcatgctgaagcgcttcggcatcgcctgcgaaacccgcgtcgtctccgcccaccgcaccccggacctgctgttccagtacgccgaagaagccgcgccgcgcggcctcgcggccatcatcgccggcgccggcggcgccgcccacctgccgggcatgctggccgccaagacccacgtgcccgtgctgggcgtgccggtgccgtccaaatacctgcgcggcgaggactcgctgctgtccatcgtgcagatgcccaagggcattccggtggccaccttcgccatcggcgaggccggcgccgccaacgccgcgctgttcgcggtggcgatgctggccaccacccggccggagctggccgagaagctggtggctttccgcaaggcgcaagaagaaaccgtgctggcgatgacgctgccggaggccgaataatggccgccatcctgccgccggcgatgctgggcatcctgggcggcggccagctgggccgcatgttcgccgtcgcagccaagaccatgggttaccgcgtgacggtgctggacccggacgaaagcgcgccggcggcggccttcgccgaccgccacatccaggcgccgtacaatgatccggccgcgctggccgagctggccgccagctgcgcggcggtcaccaccgaattcgaaaacgtcaacgccgacgcgatgcgcgagctggccaagcgcacccgcgtgtcgccgtccggcgactgcgtcgccatcgcccaggaccgcatcgccgagaaaagctggatccgcaaggccggcctcgccaccgcgccctacctggccatcgagagcgtcgaggacatccaggtggacctggcgccctatctgccgggcatcctgaaaaccgcgcgcctgggttacgacggcaagggccaggtcagagtgaacacccaggacgaggcgcgcgccgcctacgccaacctgggcggccaggcctgcgtgctggaaaagatgctggacctgcaattggaagtgtcggccatcgtcacccgggtcagcagcgcgcaaagcgcggtgtttccgttggcggaaaacatccacaagaacggcatcctcgacgaatccatcgtgccggcgcgcgtcgccccggcgctggccaggcaggcgcaggagatggcccggaagctggccgaggcgctcgactacgtcggcgtgctggcggtggagttcttcgtgctggccgaccacagcctggtggtcaacgagatcgcgccgcggccgcacaactccggccactacaccctcaccgcctgcctgaccgaccagttccagcaacaggtgcgcgcgatgtgcggcctgctgccgggccgcaccgacctgctcagcccggtggtgatggtgaacctgctgggcgacgtctggagggaagacggccgcgagccgcactgggacgtgctggccgaagcgcccaacgcccagttgcacctgtacggcaagaaaacggcgcggccgggccgcaagatgggccacttcaacgtgatggcggccacggccgacgaggcgctggagcaggccagggccttgaaggacaccctgtagcgagcgagatggcgaggccggcggcttcgccatttctcatcgcgatgacgctgaacggacgccattttcattcccggcccgcagccggggcggtcatttccgccgcggcggccggcgcggtaggcttggccgtatgccggccagaccggccggcggcaaccagatcaagaaagagcaccgtgatgaatccttccgcattttccaagaccctgtcgcaagcgctgaggccggcggcgctgctgctggcgctggcctgcgcgcccgcgctgtccgcccatgccgagacgccggccgccggccagagccagccgctggcgccgcaagccagcgccaagccgatgggcgaccaggcttaccagctgatgcaggccggccagcaggtcaaggcccacgaattgttcatgagggccgccgagatgggcgaccgccgttcgctgtcgctgctggcggacagctatggccgcaatcctaacggctacctcaagtcgccagcggtgaagaaggactaccccaagctgatccagctgttggagcgcgccgcgcgctatccggagccggagggcagcggctacaggctgaagcaggacttcgccagactgctgattaccgcgcccgcgccctaccgcgacgcgccgcgcggcagccggctgctggtggcggccaccgggcaggatgacgatggcaccgagaattactacctgctgggccagatgtacgagcgcggcgaaggcgtgccggcggatggcaagcaggctgtctattggtacgagcgcgcggccagcgcgctttccggctatacgccgcccaaggtccagcgcgcgctggcgcgcatctacaagaccggcgcgcccaatctgcccgccgatcccaagaagtcgcgcgaatggtctgacaaggccaagcacaacccgggcttccagtcgtgaacggcgggatgggcggctaagcgatggaaaacgcgctcgtcggactgccggagctgcgccgccggctggaggccgccgccgaccccgccaaacggccggcgatgcgcgactatatgcgcgggcagttcgatttcctgggattggcgacgccggccaggcgcaaggccgccggagcgtggatccgctcacaggacgcggcgggtcccgatggctggctggcggcggcggaaacgctgtggcgccagccggagcgcgaattccagtacgtggcggtggacctgctggcccgccatgccgccgaattgccggcggccgccctgccgcggctgctggcgctggttgccgccaaatcctggtgggacaccgtcgacggcctggcggcctggatcataggcgagctggtccgcgcccggcgcgaactgcaaaccgacatggacaggctgtccggcgacggcgatttctggctgcgccgcgtcgccatcctgcaccagctgtactggaagcgcgacaccgacgccgcgcggctgttccgctactgcgcggccaacgccgccgaccccgaattcttcatccgcaaggcgataggctgggccttgcgcgaatacgcctataccgatcccgacgcggtgcgcggctttgtcgccgccgctccgcttgcgccgctgtcgcggcgcgaagcgctcaaacgcattgaacccttgcctgtgaaggaagcatgatgaccggactcaccaccaccaatctgaccagcctgaagaagatctactccggcaaggtgcgcgatctgtatcagatcgacgagcaacgcatgctgatgatcgccaccgaccggctgtcggctttcgacgtgatcctggatgaccccatcccggccaagggccagatcctgaccgccatctccaacttctggtttgaaaaactgaaggacgtggtgcccaaccacctgaccggcgaaaagccggaagacgtggtggcggcggaagacctgccgcaggtggagggccgcgcggtggtggccaagcggctgaaggcggtgccgatcgaggcggtggtgcgcggctacctggccggctccggctggaaggaataccagcagtccggcgccatctgcggcgtggcgctgccggccggcctgcgcgaggcggaccagctgcccgagcccatcttcaccccgtccaccaaggcggcggtgggcgaccacgacgagaacatcagcttcgcccagtgcgaggccatcgtcggcaaggaactggcggcccaggtgcgcgacaccgccatcctgctgtacaaaaccgcagccgcctacgcggccacgcgcggcatcatcatctgcgacaccaagttcgagttcggcctggacgaaaacggcgtgctgacgctgatggatgaggcgctgacgccggactccagccgcttctggcccgccgacagctaccagccgggcagcaacccgccgtcgttcgacaagcagttcgtccgcgactggctggaagcctccggctggaacaagcaggccccggccccggccgtgccgctggacgtgcgcgagaaaaccgccgccaagtaccgcgaggcgctggaacggctgaccggctgaaaccaggcggcagcctggcaagcgtatgccagcgatttcgccgccagagcctcccgccgccggccccgcgccggcggcatggcttgagcattgtccggcattgcgactactatctactgccttgtcataaaaacgccatgccatgaccgtcgtccaaccgatactcgacaccccccgcctgcggctgctgccggcccatccggacaaggcggccgcggtgctcgactaccagctgcgcaaccgcgcccacctcgagccgtggaacccgaccgccggaccgttgttctataccgaatcccattgggcgatgcagttgcgccaggccgcccgcaactgggaagagggcgccagcgcgcgcttcctgctggcgacgcaggccgagccggaacggatcatcggcaccgtcagcttcagcaacatcgtccgcggcgtgttccaggcctgccatctcggctacggcatcgactgcgcgcgcgaagggcagggcctgatgcgcgaggcgctgcagtcggccatcgccttcgccttcgacgagctcaagctgcaccgcatccaggccaattaccagccgcacaacgtccgcagcgccgcgctgctgcaaaggctgggcttcgccgtcgaaggccaggccagggattacctgtttctcgacggcgcctggcgcgaccacgtgctgactgcgctgaccaatccgcatttcgacagccggccgctgctgggctgacgcgacggccgcgcgccgcggcctggcaaacccgctccaccaacgcaagggcaagcgcatgcaccgtacctttctgaccgccgccgacggcgaagccattccgctgtgcgaatggctgcctgacggcccgccgcgcgccgtggtgctgatttcccacggcatgagcgaatacgccgcgcgctatgaccgtttcgcccaaacgctgacggcggccggctgcgcggtgtacgcgcacgatcaccgcggccacggcgcctcccccgtcccgcgcggctttttcgccgctgaagacggctggcgcaaggtggtggatgatgtggaaaccgtgcgccgccacgcggcggagcggcatgccggcctgcccgtcatcctgctgggccacagcatgggcagcttcatcgcccgcgcctatttcctgcgctacggcggcctgctgtccggcctgatgctgtcgtctaccggctaccgccagcggccgctggcgcggctgttgggcgccgtcgcccgcttcctcgggcggcgcaagggctgggaccggcccagccggctgatggccgcgctggtgttcggcagcttcaatctgggctttccgccatggcggaccaagatggactggctgagccgcgacccggccgaagtggacgcctacctcgccgacccggactgcggcttcgaccctacgccgggtctgtgggccgacctgttcgccggcatcgtcgaaatggaaaacggcgaggcggcgggccagggcatccagcgccgctgtccggtgctgttgttcgccggcagccgcgatccggtcagcctgggccggctggcgctgggccagctggaaatccgctaccgcgacgccggcgtgctggacttgcagagccaggtctaccccggcgggcggcatgagatgctgaacgaaagcaaccgcgccgaggtggaaagcgatatcctcgcctggctggcgcgcgtcgcgcccgccgcctgaatccccgaccggagccgccatgatagaagtccaccacctgaatcaatcgcgttcgcgccgcatcacctggctgctggaagaactgggccaagactatgccgtcgtgcgctacgagcgcgatcccaaaacccggctggcgccgccggcgctgaaggccatccatccgctgggcaaggcgccggtgctgcgcgacggcgacgcggtgctgatcgaatccggcgccatcgtcgattacctgatccgcacttacggcaacggccgcttcgcgccggacatcgcttcgcccgactacaaccgctacgcgcagctgatgcattacgccgaaggctcggcgatgctgcccatcctgctgcagctgtatgtcggcacgctgggcgaggccggcgcgccgctgcatccgcgcatccacagcgagctggacaaccatctgggctatctggatggcgaactggctggccgcgattacttcgtcggcgacgatctcaccggcgccgacgtgcagctgtccttcgtcgcccagatagcggtgcgcggcgagggccgccagcgctatcccaatctggcgcgcttcgtcgaccgcatcgaggcccgcccggcttaccgccgcgccgccgagcgccacggcgaataagcccgcccgcctggcgtttgcgcaacgcgggcgggccgccggccatgcccgcgagccttacgggcgcggtggcggcccgcgccggcgctcaggcggcgatcgcctccactttgccgtccagcgccatcaggtaacgctccacctgcagttgcgggtgcttggcgacgatcatgccgctcaagcgcctcagcgtttcggcgtggacctgggtttccctggccggctgctggccgaaatcctctcccagaatcaccttgtaagcgccgcagtcgcggtggtccagcagcaccaccttcttgatgtggtgcaggtctagcgcgatgcccaggtgctgccagaatgtggcgttccaggccgggaacttgtcggtgaccgcgcccagcgccgcgccggccagcacgatgtggtcgtaattgtcgcgcaggcccaggctgtccatgaaggcggcggtttcatccaccaaccggtagtccatgcaggacaatagcagcacgtcggtgccgccggccgcccaggccgtacgcggcacaaagctgcccagcagcgcggcgccgccgcccagcgcggccaggcgcaggaagccgcggcggcccagcgggcgctgttgcagcggggtcaggcaatcggtgtgagcgtggtgtgtttcttggcacatctgttgttctcctttgtgagggcagcttcaagctgcctgccgcgattataagagcctgcgcgcgcaacatgccaagcggtttgccggcggccgcgttgacaacttacttaccagtaagtatcttgactggcagagctgacatcgccagacgaatcaaaggcttgggcgcgcagcgcccgggccgctacataacggacacgaggaagaaacatgagcgtttacccgcacctgctggcgccgctggacctgggcttcaccacgctgaaaaaccgcgtgctgatgggttcgatgcacaccggcctggaagaatccccgaacggcttcgaaaaaatggcggccttctacgccgagcgcgcgcgcggcggcgtcggcctgatcgtcaccggcggcgtcggccccaatgccgaaggctgcgtcgccgagggcgcggcgcagctgtccgacgcgcatgaggtgcccaagcacaagctggtcaccgacgcggtgcacgccgccggcggcaagatcgcgctgcagatcctgcattccggccgctacagcttccaggaaaagtgcgtgtcggcgtcccccttgatcgcgccgatcaatttctacaccccgcgcgagctgtccgacgccgacgtctggcagaccatcgccgacttcgccaactgcgccaagctggcgcaagaggccggctacgacggcgtcgaggtgatgggctcggaaggctatctgatcaaccagttcatcgcccgcgccaccaacaagcgcaccgacgcctggggcggcagcttcgaaaaccgcatccgcttcgccatcgaaaccgtcaaggcggtgcgcgcggcggtcggccccgagttcatcatcatctaccggctgtcgatgctggacctggtgcaggacggcagcaactgggacgaggtggcgcagctggcgctggaaatcgagaaggccggcgccaccctgatcaacaccggcatcggctggcatgaagcgcgggtgccgaccatcgccaccatggtgccgcgcggcggcttcgcctgggtgaccaagaaactgatgggcaaggtgaagatcccgctgatcaccaccaaccgcatcaacacgccggaagtggcggaagagatcctggccggcggctgcgccgacatggtgtcgatggcgcgccccttcctggccgacccggacttcgtcaacaaggcggcggcaggccgcgccgacgagatcaacacctgcatcggctgcaaccaggcctgcctcgaccacatcttccagggcaagctgacctcctgtctggtgaatccgcgcgcctgccgcgaaaccgagctcaactacgaccaggccgccgcgccgaagaagctggcggtggtgggctccggcccggcgggtctcgccttcgccaccgtcgccgccgagcgcggccacgcggtgacgctgttcgacgccgcggccgaaatcggcggccagttcaatgtcgccaagcagattccgggcaaggaagagttctacgaaacgctgcgctacttcaagcgccgcatcgaaaccaccggcgtggaactgaaactgaacacccgcgtggccgcggccgatttggccggcttcgacgaggtgatcctggccaccggcatcgcgccgcgcctgccggccatccccggcgtcgaccaccccaaggtgctcagctatctcgacgtgctcaagcacaagaaaccggtgggcaagaaagtggccatcatcggcgccggcggcatcggcttcgacaccgccgaatacctgtgccacgaaggccagtccacatcgctgaacgccgaagccttcatgcgcgagtggggcgtggacatgacgggcgacaccgctggcggcctggcgccgcagggcgcgcagccgcacccgagcccgcgcgaggtctatctgctgcagcgcaagaccagcaagatcggcgaaaccctgggcaagaccaccggctggatccatcgcgaaagcctgaagatgaagcgggtgaagatggtgtccggcgtcagctacgaccggatcgacgacgccggcctgcacattacggtgaagggcgagcagcagctgctgtcggtggacacggtggtgatctgcgccggccaggacccgctgcgcgaactgcagcagccgctgttggacgccggcaagccggtgcacctgataggcggcgccgacgtggcggccgagctggacgccaagcgcgccatcgaccagggctcgcgcctggccgccgccatctgatcgcccagtccgcgcagcaaaagcccccgcctcggcgggggctttttatctggaaacgaggcgggctagcgctgcgccgacaccaacagcagcatcggccgctctctttcctcggccagctccggcatcgccgccacctgctcggcgctggggccccagtcctcgatgtggcgcagcgcgaagccggcggccatcacctgattgagcaaggtgccgagggtgcggtgctgcttgatcacgccgtcggtcagccagtgagtgacgcgcggcccttcgtcctggtagccgctgaccggccagcagcgcccgccttgcgcatcctgcagccacgccggctgccgggcggccatgaagatcggatgctcgatcgagaacaccaggcggccgcccggtttcagggcccggtggcaggcggccagcaggccggccaggtcggcgatgtagtgcaaggtcagcgagctgtagaccagatcgaaggcggcaggcggcaattgcaaggtttccaggttctggcgccggtattcgatggcgtcgtcgcgggtcatcgccgcggcctgggccagcatcttttccgaaacgtccaggcccagcgcggcgctggcgccggcctcgcgcgcccagcggcagaaccagccgtagccgcagcccagatcggccaccgcggcgccttgcaatgccggcagcagcgcccgcaggctgggccattccggcgcgccggccaaaccgtgcactgagcggttcaattggctgtagccgtggaagaattcgggggtgtcgtagatgttttgcgtcattgtcaaaaaactccatgtcgggaaaagccgacggctgggcgtttgatgccaacaagacaagcccggccgcggacggcggggcttgagagggacggagctaggctcccggaatgcgcgcgcgcgtttccctctcaccccgcgatggggtgacgcggggtctggagacgatcaggatgtcgagtgcgcgcatccgtccattctaacccgttttcccgccgcgcgccggcttgtggataattgcgatggcgacgcatggctgtggataagtggacacttggttaacatctgttgcggtggggcgcgtcttaaagctttcgaaataatactcaatcagcatggcgcgcggtcgacattttcagaccgccctacgatacctacaaaggagaaacgccatgactgttcccaccgccttacgccgcgccgccctggccgccgcgctcagcctcgccgcgctgggcagcgcccacgccgccccatcgccgctgctggacgccagccacccggtcagctggtggttcgccttcaaattcaacgccgcctcctttcccggctgcggcggcgcagcccaggtcaacagctgccagttcggcggcaacccgcaaagctataccagcggcagcagctacagccagcaatacgtctacgccagcagcagccagcccagcctgagccagggcggcggctgcatcggcgacacgccggccgatccggtcggcgccaccttcaaccagatctacaacggcaccttgaactacgtggtgtggaacgaccagttctacgacgacccgtccatcccctcctgctccggcaacgcctgcaacgcgccgtgggggcattccaagggcgtgctggcctgggacgcgcagggcaacggcgtggtgatgcaggtgagcacgccgtcgtggccggcttccggcagcgcgcaatatccgcgcagcagcgacggcaacaccctgggctgcgtgcaggacaacgatgtcgaagtcagccagcatttcttctcgctgaaactcagccatgccgacgtgttggcggtgctgcagggcctggccaacgccagcgcggtgaccgatccgggcaatccgcagatcgtcaagaacggcggcccggccgatatccaggcggcggtcagccaactgggccagcaatcggacagcgtgacgccgcaggtgagcaagctgtccagcggcgtcaccctgatcgccaagccttccgcgctgcaagtggcgccgtggcaactggtttcggccgagctgggcggcatttcgctgcgcgccgccacctggtgggaagccagcaagagctacgcgattccgacgaccaccaaggccggcgcgccagcctgctgggatagcagcctgccggcgccgggtccggtggccatcgccacctccggcagctgggccggccagaccttctcgctgaagggcgggctgggcaagaacttcaaccacgccaagatcggcgtcagcaccagcggcggcaccgcctacgcgattttcggcgacatgaaccaggaaggcgcgctgtccggcaattgcgccagcgcccagaacggccgcggcggcctgttcttcgcgctgcccaacgccgcgctggcgcagtccatcggcaagctgatcggcggcagcaccgccgccgccgcgcgctgacgcggtccggtgttcaggcgaaggcggccagcatgaagtcgatgaagctggccagcttgggcgtcggccggcggtcggccgggtagagcagatgcatggggcggctaggcagcggatggtcgggcagcaggcgcagcagccggccggcggcgacgtcgtcggccagcagcgcctccggctgcatcacgatgcccaggccggcgagggcggcggtgcgcagcgcctggccgttgttggcggtgaagcgcccgcgcaccgccacgttttcgccggagccgaagcgccagcgattcttgtggcgccagtaggcgaagcccaggcaatcgtgcccggccagctgcgccggctcggagggcgcgccgcgttcggccaggtaggccggcgcggcgcatagccacatccggtagggctgcagcggcctggccaccaggctggaatcggccagctcgcctatccgcaccgccgcctcgtagccttcctccaccaggtccaccatccggtctgccaatgtcaggtccacttccacctcggggtggcggcgcaggtagacggccagcgccggcgccaggcgcaggctgccgaaagtcaccggcgcgtggattttcagcaggccgcgcggcgcggcgcgcaaggcgtcggcgcagccgtcggcgacggcgatgtccgccagcagctggcggcaatgctggtagtagatgcggccgacctcggtcagcgattgctggcgggtggtgcggttgagcaggcgcgcgccgacgcgcgcttccagcgcgcggacatgtttgcccaccatggtggccgacaggccgcaggcgtcggcggcggcggtgaagctgcctttgtccacggcctgcacgaatatcgccatgctgctgcaaagatccagcattgagaactcctggtgcgcagtgatcgcaccgttcacgcgtttatcaatccattcatcgcaatgatactgatgacggacgcatttgcgtcggcacgcacaggagaatttcgatgatacgcaacgacgcgcaataccaaaaagggctggagctgatggcgtttctgcatggcggccacaccggcggcgcgcgggtggcgcagatccaggacatttgtccggacttcgccgacatggccatcgcctgggctacaggccacatcctgagccggccggggctggacctggccacccgcgagctgatcctggtggcgtcctgcgccacccagggcttcgcgcagacgcagctggtggcccatgccgaggctgcgctgcgcgccggcgccagccggcggcagatcatggagaccgtgctgcagctgactttctacgccggcgggccggcggtgagcaatgcgctgctggccttgaaggacgtgctggccgaggaggcgtgaagcgcgcgggccggaaatcggcatgactgatatttgtcattgattttcaatgcattatttgccatgttcatattttccggccgctaccggcatctcgccggcggggacggcctttcattgcgaggagcgttcatgagcatcaggcatgtgattctgctggcggccgccttggccttgccggcctgggcggcggagccgctgccggccttccacggcgacgcccgccagtcttcggtgtccggcttgtcgtcgggggccttcatggcggtgcagtaccaggtggcgtattcggcgtcggtggtgggcgtcggcgtggtggccggcggtccgtactattgcgcgctggacagtttcgccggcaccgccgcctgcatgagcggcccgccgcccagcgcggcgcagttgctggccgcggcgggcatcttcgccgccggcggccatatcgacccgctgcccaacctggccaggagccgggtctacctgttcagcggcagccaggacaacacggtgaagacgccggtggtcgacagtgccgccgccttcttccgcctggccggggtgccggacaggcagatccagtacgagcgccggctgccggccggccatgcgcagatcacgccgacctacggcaacgattgcggaaccaccgcctcgccctacatcaatcattgcagctggcagggacagggttacgaccaggccggcgtgctgctgcggcacatctacgggccgctgcagcccaaggcgcaggcgctgggcggccgggtggtccgcttcgaccagcggccgtatgccgccgtcggcagcagcctggccgacgagggcttcgtctacgtgcccaaggcctgcgagcaaggcgaggcgtgcaaggtccatatcgcgctgcacggctgcaagcagtacgccggcgcggtgggcgacgacttctacgctcacgccggctacaacgagtgggccgacagcaaccgcatcctggtgctgtatccgcaaaccaccacctcggcggcgaatccgcagggctgctgggactggttcgcctacaccgggccggcttatgcctggaaggaaggcctgcagatgcaggcgttgaaggcgatggccgaccgcctggtttccgcgcgctgaggcggcgccgaaaagcggacgccccgcttggcgcggggcgttttcattgcggcgggctgggcttactcggccgcgccggcgcggcgtgccttcaccgcttcggccaattgggtcagcagcttctcggtgtcgctccagcccaggcagccgtcggtgatgctctggccgtaggtcagctcgtagccgggcttctggtcctggcggccttccaccaggtggctttccaccatcacgccgaagatgttgcggtcgccgccggcgatctggccggccacgtcggcgctcacttccatctggcggcggtagtccttgcggctgttggcgtggctgaagtccaccatcagcttgtgcggcaggccgaccgcggtcagttcggcggcggcggcgcgcacgtgctccggcgagtagttgggttccttgccgccgcgcaggatcacgtggcagtccggattgccgccggtggagacgatggcggaatggccggtcttggtcaccgacaggaagtggtgcggcacgctggacgaacggatggcgtcgaccgcgattttcaggttgccgtcggtgccgttcttgaagcccaccgggcaggacaggccggaggccagctcgcggtgcacctggctttcggtggtgcgcgcgccgatggcgccccagctgatcaggtcggcgaagtactgcggcgtgatcatgtcgaggaattcggtggcggccggcatgccctggttgttcagcgtcaagagcaggcggcgggcgatgcgcaggccggcgttgatgtcgtacgactcattcaggtgcggatcgttgatcagacccttccagccgacggtggtgcgcggtttctcgaagtacacccgcatcaccaccactagctcgccggccagcgcggcgcgcagcggcgccagcttctgcgcgtattcgatcgcggcgtcggtgtcgtggatcgaacaggggccgatcaccaccagcaggcggtcgtcctcgccgcgcagcagcgccgagatgtcgcggcgggtgttgtagatcagctcggaagcctgttcgctgatcggcagctcatacaggtgggcgataggcgggaggagttccttgatctcgcggattctgacgtcgtcggtctggcgttgcatgctggtgtcccttggctaacttgttttctgcatagcagcaagataaccgcatttgtcggccccagacaacccagcatgcaaaaagcgccacggcctggcggcggtggcgctggattagggaaggcgcggggtatcagtccgcgtactggcgcttcatgcgttcgcggcgctcttgcgcctccaccgacagcgtggcggtcgggcgcgccatcaggcgtttcaggccgatgggttcgccggtgtcctcgcagaagccgtaggagccgtcgtcgatctggcggatggacgcctggatcttctgcagcagcttgcgctcgcggtcgcgggtgcgcagttccagcgcgtattcttcttccagcgtggcccggtcggcgggatcgggtgtcgcttcctgttcctgcaaatggttggcagtggcgttggcgtttaccagcaactcctgctgcatttgcaacaaccggtccttgaagaactcaagatggtcggcgttcatgtaatcatcgccttcccagttgaggatatcctgttcggtcagtttagccatgtttggtgcttccagcatagagttggcaacaggcggagaagattaccggcgggccaatgtttgcgcaactgtcttgagcttgaaatccaaataatcacccactgccgctaacattcggtatagcccggtttcgcaccgataacaagctcgcccattttgggaaacgtaatcagagtgcgggtttcgaccggatattcccatacaagttcaaaggcggcttttgccgcctttgaattgaggcaagcctggttgcggacttgccgcacacagacaatgccggtgtttatttctggctgagcacccatttgaccagcgccttcaggtcggcgtcgggaatattcgggtgcggggtcatcgggatcgggccccatacgccggagccgccgtttttcaccttggccatcagcatcgcctcggcgcctttctggccggcgtatttcttggcgacgtccttgtaggccgggccgacgatcttcttgtccaccgcgtgacaggccgtgcagctgtacttctgggccagttgcaggctggccatcgccggcgcggcggccaggcccagcagcagggcggcaagcagggtctttttcatgtgattctccctatcgtttcacgtggccgccggccaaaacggccggcagctgtccaaaagtatgacaaataacccgctttactggagtacgaccttgagttgggtcaagaagcctgcttccagcgcctgcaccggcagcatcatgatgacttggatgatcagcagcagcaccagcggcgacaggtcgacgccgcccaccaccgcgcggcggaacggacgcaggaacggccgggtcaggctgtccagcaccggcgcgatcggattgtaggggttgacccagctgagcaccgcttgcaccaccaccgcgcccatcagcagggtcagcgactgcttgaacacttccagcaccgacagcaggaacagcgaaacccacacctgcgggaaagcgaacacctcgggcagcgagcccagcaacagcctcaggatattggccagcaggcagaccagccaggccagcagcagggtggcggtgtcgtaattccgcaccgagggcaccagcttgcgcgtcggcagcaccaggaagttggtggcggccatcacgaactggcacagcggatgcttgaacggcgcgcgcgccacctgcaggtagaaacgcagcagcagcaccagcacgaacaggccggacagggtcttgatcaggaactgcagggtatcgacaaacatgatttcggcttactcctggctgagttgttggcccatttcgattgaacgctcgcggcaatccatcgcgccggcgacgatggccgccttgacgccctcggcttcgaagcgggcgatggcgcgctcggtggtgccgcccttggacatcacgttctgcctgagcgtcgctaccggcagcgggctttgccgcgccagctccaccgcgccgtcgaaggtcgccaatgccagctcgcgcgcctgggcctcgctgaagccggccttcacgccggcctctatcatgctttctatgaaatagaacacgtaggccgggccgctgccggacacgcaggtgatgtcgtcgatgccggtttcgtcgtccagccagacggtgaggccggcggcgcgcatgatggtttcggcggcggcgcggtcggccgcgggcacggcggcgtcggcgtacaggccggacacgcccttgccgaccatggccggggtgttgggcatcacccgcacgatgcggccgctgcccagccagcgcgagagcgcgtccaggcggatgccggcggcgatcgacaccaccagcgcgccgttaagcgcgggcgccagcgccaggcacagctcgcgcagctgctgcggcttcaccgccagcaccaccacgtcgccggcgtcgaaacgctcgggcaaggtctggccgccgctggcgccgaagtcggccgccagccggtctattttgtcctgctgatgctccaccacgtggatgcggtggccgccctggcgggccaggccgccgatgatggcgccggccatattgccgccgccgatgaatgtgatgcgcatgatgctgtccccttgcgattgcggctcccggcccggccgggagccgatgtttattgcggctggccgcgccggccgaagatggccgagcccacccgcaccagggtggcgccttcggccaccgccagctccaggtcggccgacatgcccatcgacagcgtgtcgagcggcaggccttcggcgcgcagcccttcggccagcgcgcgcaaggcggcgaactgcgccgccagcctggctgcgtcggcggtcggctccggtatgcacatcaggccgcgcaggcgcaggcgcggcagcgccgccaccgctcgcgccagcgccgccgcctcttcgggcgcgcagccgctcttgctggcctcgccggacacgttgacctgcacgcagacgttcagcggcggcagagagtccggccgctgcgccgacagccgttcggcggttttcagccgctctatcgagtgcgcccaatgcgcgagttcggcgacgatgcgggttttattcgactgcagcgggccgatgaagtgccattctatcgccaggtcggccaaggcttcgcacttctgttgcaattcctgcacgtagttttcgccgaaggcgcgctggccgcaggcgtaggcttcgcgcaggtcggcggcggggaaggttttgctcaccgccagcagcgcggccgcgtccggcgcgcgtccggcctggcggcaggcgtcggccagccgcgcgccgacctggcgcagccgggtggaaagggtgtctgtcatgtcgtttttgtccgtgagcctccgcgacgggggatatccggctgtccggccaacgcatacaatgcattgcaggaccggccatgccagcggggaatcggcggcggcggcgatgtcatcgaggagaattatatggaaatttccgagctcctggcttttaccgtcaagaacaaggcctccgacctgcacctgtcggccggcctgccgccgatgatacgggtgaacggcgacatccgccgcatcaacctgccgccgctcgaccaccatgacgtgcacgacatggtgtacgacatcatgaacgactaccagcgcaagatcttcgaggacgtctacgagtgcgacttctcgttcgagctgcccggcatcgcccgcttccgcgtcaacgccttcgtgcagaaccgcggcatggcgtcggtgttccgggtgatccccagcaaggtgctgtcgctggaacagctggcggcgccgaagatcttccaggagatcgccggctatccgcgcggcctggtgctggtgaccgggccgaccggctccggcaagtccaccacgctggcggcgatgatagactatgtcaacgaaaacgacttctcgcacattcttaccgtggaagacccgatcgagtttgtccacgaaagcaagaaaagcctgatcaaccagcgcgagctgggcttgcagacccagagcttcgccaacgcgctgaaaagcgcgctgcgcgaggaccccgacgtgatcctggtcggcgagctgcgcgacctggaaacgatacggctggcgctgaccgcggccgaaaccggccacctggtgttcggcacgctgcataccagcagcgccgccaagaccatagaccgcatcgtcgacgtgttcccggccggcgaaaaggaaatggtgcgctcgatgctgtcggaatcggtgcgggcggtgatcgcccagacgctgctgaagtccaaggacggccaggggcgggtggcggcgcacgagatcatgataggcacgccggcgatccgcaacctgatccgcgaaaacaagatcgcgcagatcaactcgatgatacaaaccggccagcagcacggcatgcagacgctggaccagtgcctggcggagctggtgcggcgcaatatggtgtcgccgggcgaggcgcgcgccaaggccagcaacaaggattcgttctgaaaccgcgcttttggcagaaggccgcggccgcaatctcccgctgcgcatggcgtcggcgggctagactggaagcagtttcacgcagggtaagccgccatggaaaaagaccaggcctccaaattcatccatgatctgctgaagcacgcgatcggcaagaacgcctcggacatcttcatttccgccgaatttccgccggcgatgaagatagacggcaagatcacgccggtggcgccgcaacccttgtccgcgcagcagagcaaggagctggtgcgcgccatcatgaacgaccgccagaccgaggagttcgaggcgaagaaggaagccaatttcgcgatcaacccgcccggcatcggccgcttccgcgtcagcgccttcgtccagcagggcatggtgggcatggtgctgcgcaagatcaacaccgacatccccaacttcgaccagttgagcctgcccgaggtgctgaaggacatcgcgctgatcaagcgcggcctggtgatcttcgtgggcggcaccggctccggcaagtccacctcgctggcggcgctggtggactggcgcaacacccacaaccaggatcacatcatcacggtcgaagacccgatcgaatacgtgcatacccacaagaagtccatcgtcacccagcgcgagatcggcgtcgacaccgaaaactgggaagtcgcgctgaagaacacgctgcgccaggcgccggacgtgatcctgatgggcgagatacgcgaccgcgaaaccatggcctacggcctgcagttcgccgaaaccggccacctgtgcctggccacgctgcacgccaacaacgccaaccaggcgctggaccgcatcctcaattttttccccgaagagcgccaccagcaggtgctgatggacctgtcgctgaacatgcgctccatcatttcgcagcggctggtgccgcacaagtccggccgcggccgggtggcggcggtggagatcctgctcaacagcccgctggtgtcggacatggtgttcaagggcgagatcgccggcctgaaggaggtgatggcgcgctcgcgcgaggccggcatgcaaactttcgaccagtcgctgttcgagttgttcgaggccgagctgatcacctacgaggacgcgctgcgcaatgccgactccatcaacgacctgcgcctgagaatcaagctctacagcgaaagcggccgcaaccgcgacccgctggagggcatcgaccacctggatattgtctgaacggcgccacgccataagccatcatgcattttgacgcctctaccaccgtattgatcatcgaagactcccacactgtgcgccagggtctgcgcaccatgctgtccatggccggcatcacccgctcggaagccgtcagcaacgccagcgaggcgcgcaaccgcctgcgcggcaagccttacgacgtggtgctgtgcgactacaacctgggcgaaggcatggatggccaggaattgctggaagccatgcgcaagggcggcaacctgcccttggccaccatctggatcatgatcaccggcgaacgccactacgaaagagtggtggccgccgccgagatggcgccggacgactacatcctcaaaccgttcgcctcgcagctgctgctggaccggatgaacctggccggccagcgcaaggccttcctcgcgccggcgcacaagctattgtccgccggcaaagtggagcaagcgatccaggtgctgcagcaactggcgcgcgaaacctccaacccgcagtaccggctggacgcgcagcgcctggccgccgaattgctggtcaacgaaggccgccagggcgaggcgctgtccatctaccaggagctgctgacccagcgggtgatcccctgggccaagatgggggtggcgcgcatcgtcgccgagcagggcgaaagccaggaatccaacgcgctgctgcgcgagatcatcgccgaagcgccgcgctataccgacgcctacgacctgctggcgcaaaacctgatcgacgacggccagtaccagaccgccgcggtggtgctggagaaggcggtggcgatctcgccgcgcaacttcaaccggctgaagagctgcggcaccgcgctcttgcgctgcggcgacccgaccaaggccgccgactacctgcagcgggcggtggaagtcggccgcaacaacaatttcttcggccccgacgtgctggtggacctgctgcaggcctatagcgaaagcggccagacccagcaactggaccggctgcaggcggaaatctccagccgcatggacgagttgcccggcggccagctgacgatggcggtgtgccgggcgctgaccgcgctggcgcagaagcgccccagcgacgcgctggcccagttgcaatcggtggcggaagacctgcgcgcccgcgaaaccgacttccccagcgcccagcgcttcctcgccgccgcggtgcggctgccggcggaagtcaacagcgagctgccgccgcagtgggcgcacagcatcgcgctgcgcttcgccgacggccgccacgagctgggcacgctgctggagatcgcgcataagcacgaggcctgccacggcgccatcgaaaccgcctacgacacgctgcagaccgaaagtaacaaggcggtggagctggccagcaccggcaagctggaagaggccgccgccatgctctacctgctgtcgcagaagacgctgaacgagcgcatcagcatgaacgcctgcgcgctgctgctgcgcacctgcgaaagccgcagcaaggccggcaagccgtacccggaggaagaccgccaggtgctgcagctgatgcactggctgccgcaggacaacgagcgggtgcgcggcttcatccgccgccaccatgcgctggacccggaatgcgaatgagcgcgccgccgcggcgcggcaggctagactggtagcaatcgacgccgggtccgcccggtccgccatccaccccgccgcggccgccggccgccggcacccgcgaggctgtccatggctttcaaggcgaacaccacggtattgatcgtcgacgacgcgctgaccatggcccagggcatccgcgccatcctggccatggccggcgtcacccagtccgaaaccgccagccacgccggcgaggccagcaaccgcctgcgcgccaagcgcttcgacatcgtgctgtgcgactacaatctgggcagcggcatgaacggccaggagttgctggaactgatgcgcaaaagcggcacgctgccgctgtcgacgctgtgggtgatgatcaccggcgagcgcaattacacccaggtggtgaccgccgccgagaccgcgccggacgactacttcctcaagccgttcagctcgcagcagctgttggaccggctggagctggcgctgcagcgcaaggcttacctcgcgccggctcaccggctgctggagaagggcaagaccgagcaggcgatccagacgctgcaggaattggcgcagcaggccgacagccggcaaagccggctggacgcgctgcggctgcgcgccgagctgctggtgagcgaaggcctgtacgagccggcgctgcaggtttaccaggggctgctggcgcaggaggagattccctgggccaagatgggggtggcgcgcatcctggccgaacagggcgacagctcccgctccaatgtcctgctcgacgaggtgatcgccatcgcgccgcgctacaccgacgcctacgacctgctggcgcagaacatggtggacgacggcgcttaccaggaagcggccgcggtgttggaaaaggcggtgggcatctcgccgcgcaacttcacccggctgcacaactacggcaaggcgctgctgcgcagcggcgaggcggcgcgggcggccgaccagctgcagcgcgcggtggacatcggccgcaacaacgccttcttcggcccggaagtgctggtcgacctgatgcaggcgcgcagcgaaagcgggcagacccaacagctggaccggctgcagaacgacatctcgacccaattgggcaagcagcccggcggccaattgatgctggcggtgtgccgggcgatggcggcgctggcgcagcagcggccggagcaggcgctgggccagctggaggagggcgcggaatggctgcgggcggcggaaaccactttcgacggcgcgctgcgctttttggcggcgacggcgcggctgccggccggccaggccgccgcgcaggcgccggaatgggcgcgcgtgatcgccttgcgcttcgccgacggccgccacgagctgggcagcctgcaggaggccgcgcgccagcatccggcctgcctggcggcgatcaggaccgcctacgacgagctgcagggcaagagccaggcggcgctggaactggccaaccaggggcagttggaggctgccgccgacatgctgcgccgcgacgcgatggccaccctcaaccagcggctgggcatgtatggctgcgcgatgctgctgcgcatctgcgaaaaccgccagcaggccgcgcaggactacgccgacccgctgcaggatctgcgccagctgctgcaatggctgccgcaggacaacgaaagggtgcgaggcttcgtcaggcggcggcaggcgctgctgcgcccgcgcgcctgaaatggcccatgcgcgtcttcctggcctgtctgccgccgcccggctgtctgccgcggctggcgcagtggcagcgggcgatgcagcgcgaggctggcggccgttgcctgcccttgccgcagctgcatctgaccctggcgttcctgggcgagcttggcccgctggccctgcagcgtgccgccgattgcgccgagcgggcggcggcggacctgccggccagcctgacgctggattgcctgggcagctgggaaggcggaataggctggtgcgcgcccgcggcggccgacgcggcgctgcaggcttgggtgatggcgctcaggcgggatttgcgcgcgcaggggctgcggctggacgcgcagccgttccggccgcatctgacgctgctgcgcaagctgcgacagccattgccgccgcagactgtgccgccgttgcggctggcgctgcgcgagctggcgctgatcgcgtccagcctgagtgccgacggcgcgcgctaccagcgcctggacggttggcgcggcggcgcggctcgctagccggcgcaggtctcggtcaggcggacgcgtccgccgcgccggcatcccagcgcgtcgcggcttcggcgtcgctgtcgcgcgcctccacccaatgccggctgccgtcggcgaggatctcgcatttccagaacggcgcctgctgctttagatagtccatcaggaaggaggcggcttcgaaggcgtcgctgcggtggctgctggccgccaccaccagcacgatggggtcgcccagcgccaggcggccgacgcggtggatcagcgtcacgcccttcagcgaccagcgcttgcgcgccgcgcagacgatgtcggccagcgccttttccgtcatgcccgggtaatgctccagttccagcgccaccacgtcctggcggtcgccgtagtcgcggaccaggccggtgaagctgaccaccgcgccgcaggccgggttggccgaccagcgccgcacctcggcgccgacgtcgaaggcctcggcctgcacccggatgtggttgatcgtcatgtcagcctccggtcaccggcggaaataccgccacttcgtcgccgtcggccagcggggtgtcgccgctcgccatgtcctggttgaccgccacccggaaggtttgcccggccgccagcgcgcgcgcccactcgccgccgcgttggcgcagctcggccagcagctcggccacggtggcggcctcgctgtccagtgtttccgaatccagccccagcgtgtcgcgcagccgggcgaaatacagcatgttcaattgcatcgtgcgatctttcctgtaggcggccggcagcggccgcgcctcgatggggctagtgtaagcaatcggggccggccagccaatgccggcgctggcctagggtttgggcggccggtcgcgcagggggtcgtaccacatcgacttgtcgttcagcggcgcgctgtccggcagcagcggattggcgaacgggatcagccggcgttcgctcatccgcgcctggcgcagcgcgtcgcggtggtatttccagaagatggcgtcgaagctgccgtcggcgcgcatccgcgcaagtcccagccgcaggcgttccgtcagcgcgggatcgtcgcggttgcaggaaaagtagtagggccacgggtaatagaacagcaggcgctgctcgacctccagattcgggtatttgccgtggaaatgccggtattcgtcgaacacctccagcacgctgcgcggcagcaggtcgaagcggcgctggcttagcatgccgaacagcatgtcgtagcggccggtgctgacccgcaaggcggcggcctggtagaccttgatgtcgccccagcccttgccctggccgatcaggaagcggccgaggtcggcgcggctatgcacctggtcgaattccggctggcgcttgccgtctatcagcgcgatgcggtagccgagcagccccttgcgcaggtccacccgcaccggcagcaggctcagctcgcgtgcttccgaggtggagctccaggcgacgttgacggcgtggccgcggcgcagctcttccagcgagcgctcttcgtccatcggccagccgctgggctgcagcgtgtaggggccgtaggcgtcggcggttttgtccagcgcggcgcgcagcagttcgcggatatcgtcgtaacggaacgcgtcggcgctgtcgccgaccgggtacaccacgcgcatcggctcggccgcgaggacggccggcgccaggcaaagcaacagcagccaccgccacatcgccgctctccctcgggaatgtcactccattcagcatagccgcgccgatggcggctggcgggcgggcataaaaaaacccgcctggacggcgggtcgggcagaaagcatggctttcgcttgccgcggcggctggcttgagcgcggcggggcgagcaaagatgtcatgcgaaaccctttcctgaaatgacaaatgaattattgcagcaagcgccgcgcgccgcaaggctttttacaatagccctacaaaccgcggcggcattcatcgccgggcgggctcagcgcacgatctgcgcgagctggcctttcaggtagagattggccatggtgtccagattgatggccttgatcttgctggcctggccgcaggcgccgaaggcttcgtagcgggcgatgcagatgtcgcgcatcgcgtcggtggacaccttcaggtatttgcgcgggtcgaattccttcgggttttgcgccaggaagcggcggatggcgccggtggaggccaggcgcaggtcggtgtcgatattgaccttgcgcacgccgtgcttgatgccttcgacgatttcttccaccggcacgccgtaggtttcgcccaggtcgccgccgaattcgttgatgatttgcagccactcctgcggcacgctggacgagccgtgcatcaccaggtgggtgttggggatgcgggcgtggatttccttgatgcggtctatgcgcagcacgtcgccggtgggcttcttggtgaacttgtaggcgccgtggctggtgccgatggcgatggccagcgcgtccacgccggtgtccttgacgaagcgggcggcttcttccgggtcggtcaacagctggctgtggtcgagcacgccttcagcgccgacgccgtcttcctcgccggccatgccggtttccaggctgcccaggcagccgatctcgccttccaccgacacgccgcaggcgtgggcgaagttgaccacggtgcgggtgacgtcgacgttgtagccgtagtcggccggggtcttgccatcggatttcagcgagccgtccatcatcaccgacgagaagcccagctggatcgagcgctggcagacgtcggggctggtgccgtggtcctggtgcatcaccaccgggatgtgcgggaattcttccaccgccgccagaatcatgtggcgcaggaagggcgcgccggcgtatttgcgggcgccggccgaagcctgcacgatcaccggcgcgtcgaccttgtcggcggcttccatgatggcgcgcatttgctccaggttgttgacgttgaaggccggcaggccgtagctgtactcggcagcgtggtccagcagctgacgcatagaaacgagtgccatgaaattctccctcatgggcttcgccggcggcgaagcttgtttgcaaaaaaatgaagcggctggcgtatcgccggccgccgaaactattgacgcgacaggctggtcagcagcacgccggcgccgacgaaggcgccgccgctgaagcggttgaccagcttcagccggcgcgcgctgttcatccagcccgccagcttggcgccgctgctggcgtaggtcagttgccagctcgactcgatcacgaagaacgacagcgccaggatggccagctgcggcccctggggctggtgggtgtccatgaattgcgggaacagcgcggcgaagaagatcagcgccttggggttgctcatcgccaccaggaagccgcggcggtacagcgcccaggggccgtgctggccggcggcgtcctcgcgcagttcggccaccggttgcggcgggctgcgccaggttttcacgcccagatacaccaggtataccgcgccggcgtacttgatggcggagaacagcacttccgaggtggccagcaccgcgcccagcccggccaccgaggccagcatcagcaggcccagcgcgctcatcaggccgaagcaggtcatcagcgtgcggcgcacgccgtaatggatgccgtgggtcatcgccagcagcatgttggggccgggcgtggcggacacgaaaaacatggtggtgatgaacatcagccaggtgtgcagcggcatcatttctcctcggttgtcgcgggcatccgccggtaggattccgaccttgcgattatcgcccatcctgggccggcgcgcaggccggccgcggcatgggtagttttccttactgcgcgcgctcggccaggatggccaccgccggcagctgcttgccttccaggaattccaggaaggcgccgccgccggtggagatgtagccgatgtcgccggtgatgccgtacttggcgatggccgccagcgtgtcgccgccgccggcgatagagaacgccttggattgggcgatggcctgggccagcgtcttggtgccgttgccgaactggtcgaactcgaacacgccgaccgggccgttccacacgacggtgccggcctgggcgatgatgccggccagctctttggcggaatccggcccgatgtccagaatcatgtcgtcggcgctcacctcggccacgttcttggtggccgcggcggcggtttcggcgaattcggtcgcgcagaccacgtcggtgggcagcggcacgtcgccgccgcgggcgcggatcttggcgatgacgcgcttggcgtcttcgaccaggtcggcctcggccagcgatttgccgatggccttgccttcggccagcaggaaggtgttggcgatgccgccgccgacgatcagctggtccaccttgtcggccagcgcctccaggatggtcagcttggtcgacaccttggagccggcgacgatggccaccagcgggcgggccggcgccagcagcgccttggacagcgcgtccagctcggccgacagcagcacgccggcgcaggcgagcggggcgaactgcgccaccgcgtgggtggaggcctcggcgcggtgggcggtgccgaaggcgtcgttgacgaacacgtcgcacagcgcggcgtaggcgcggcccagctcggcgctgttcttcttttcgcctttgttcaggcggatgttttccagcatcaccacctcgccggcggcgagcggcacgccggcctgccagtcggctaccagccgcaccggcttgcccagcaggctggacaggcgctccaccaccggcgccaggctgtcttccggcttcggctcgccttcggtcggacggcccaggtgggtcatcagcatcacgccggcgccggcttgcaggcacagctcgatcgacggcaggctggcgcggatgcgggtgtcgtcgccgatcacgccgtttttcagcggcacgttcatgtcgacgcggatcagcacgcgcttgccggcaaggttctgttcggagagtttgttgaatttcatcgtttcactcactcgggtttggatgcgggatgatcgggcaaggcggcgggccgggtcacggcgccgccgcatttcttgcagaacgggaaaaaggcgaaattgcgcgcgccgcaggcgcagacgcggaacagctgcaggccgcaatggatgcagtagtcggcgtcgtcgccggcgatattgtattgatggtcgcacgacgggcagctgcgcttctgataggacagcagcgccttggcgtaggcgatgcggccggcgcgctggccctggctttgctgcagctccgcgcgttttttctcggcgtagcgctggaaggcctggatcatgcgcatgccggcgaacacggtgagcgcgatgccgaccaggaagcgcacatagccgccgaagctgggcagatagggcagcagctcgacgaagaaggcgaacagggcgaacaggccgaagccgtagacgaagaaccagtagcggtgggcgcggtagcgcaggaacagccacacgcccaagagcagcagcggcaggatcaccaccagccgcagcgcgaacactttcaactcgaagcggtcgctggcctgctggtattgctcgccggcttgttgctccaaccggtcgacctgggcttgcagcgtctgttgccgttgcgccagcgccagcaggccggagctggcctggtcttctttctgctgccattgcaggatctgcgcctgcagcgcgtccagcgcgcgcgcgcgtcgcaccacctcgccgctctggccggcatcggcggtggcggcgcggctggccagccagttgtccagtccctggcgctgggtctggtagctgcgctccagctggccgcgggtggcggcgagcttctcttgttcggcgcgctgcgcttcggtttgccgctgcagctgttcctgctgccgtttcagcgggtccagcccgatgcgctgtcggaaagcttcctgttgcggcggcccgcctgccggcaggtagaacaggtcgcggatcaccagttcgccgaggccggccagcagcgcggcgaataccagcgccaccagccacgaggccaggcgaaccattttttccggccgggacaaggcctgcccttgctgcatcgcgttctccatctcagtgtccggggggccggccgcctggcgcgggatggcgggccctgttggcaagtgtatgccgaaacgacggcgcaactttaacaccaatcaaatttcatgcgcgctttatgtaacaaaacaacagggcgaatggcataacagccgctcgccccgtcgccatgcgcgcctgattccggactcagcagcggaacatcgcgcgcgcggtgcgcagcatctggcagctgaaaccccactcgttgtcgtaccaggccagcaccttcaccatattgccgccggtgaccttggtcagcgtggagtcgaaggtggaggcttcgtcggtgtggttgaagtcgccggaaaccagcggcagcgtgttgtagcccaggatgccctgcatgccgccttcggacgcggccttgaggatgtcgttgacctcgtccttgctggtgtcgcggctggcggtgaaggtgaggtccaccagcgaaacgttgatggtgggcacccgcaccgagaagccgtccagccggcctttcagttccggcagcaccaggccgacggccttggcggcgccggtcttggtggggatcatgttgtcggtggcggagcgggcgcggcgcaggtccttgtgcttgacgtcggtcagcacctggtcgttggtgaaggcgtggatggtggtcatcaggcccttcttgatgccgatcgcgtcgttcagcgccttggccaccggcgccaggcagttggtggtgcagctggcgttggacaccacggtcatttccggcttcagcgtgtcgtggttgacgccgtagacgatggtggcgtcgacatcgtcgccgcccggggccgagatcagcaccttcttggcgccggcgtcgatgtgggcctggcacttttccttgctggtgaaggcgccggtgcactccagcaccaggtccacgtccagttccttccacggcagctcggccgggttgcgggtgctgaagaacggaatcttgtcgccgttgaggatcaggtggcgctcatcctgctccacgctgccgggaaagcggccatgcacggtgtcgaactgggtcaggtgcgcgttgatgccaaggtcgccggaggcgttgaccgccactaccgtgaaatcgtcgtgcaacttgttttcatagatggcgcgcaaaacctggcggccaatgcgaccgtaaccgttgatggcgaggcggatggtcatgctacagggtctcccggtaaaacttttgtagtgcggcgactacatggtgtggcgaaaaaaaggccatcgcgtcgccgcgatggcctgattgctggcttagcgtatcacggagcgggtcttggcgaccacgttttccacggtgaagccgaattccttgaacagctggccggccggcgcggattcgccgaaggtggccatgccgaccaccgcgccgtccaggccgacgtatttgtgccagaagtccgggtggccggcttcgatggccacgcgcggcaggcccgccggcagcacgctgtgctgccaggccttgtcctgggcgtcgaacacgttggtgcaaggcatcgacaccacgcgcaccgcgacgccttcggccgccagcgcttcctgcgccttcagcgccagctccacttcggagccggtggcgatcagcacggcgcgggcgcctgcggcgtcgcgcagcacgtagccgcccttgcggatgtcggccagctggcgctcgtcgcgggcgacgaagggcaggttctggcggctgaggatcaggctgctgggcgtggttttctgttcgatcgcatgcgcccaggccaccgcggtttcgctggtgtcgcacggacgccaggtgtggtggttggggatgtagcgcagggtggccacttgctccaccggctggtgggtgggaccgtcttcgcccaggccgatcgaatcgtgggtgaacacgaagatcggattgatcttcatcagcgacgccatgcgcagcgcgttgcgggcgtattcgctgaacatcaggaaggtgccgccgtacgggcgcaggccgccgtgcagcgtcatgccgttgatgatggcggccatgccgaactcgcgcacgccgtagctgatgtaattgccgttgccttcgccgtctatccacttgctgccggaccaattggtcaggttggagccggtcaggtcggcggagccgccgacgaattccggcagggacggcgacagcgcttccagcgcgatctggctggccttgcgggtggccacggtctgggcggcgtcgctgatcttggccagcgcggcgttcagcgtctcgtgccagccggccggcagctcgcccgccatgcggcgctcgaactcggcggccagctgcgggtgggcggcgcggtaggcgtcgaagcgctggttccattgggcttcggcggccgcgccctggtcgcgggcgttccattcggcgtagatctcggccggaatttcgaacggcgcgtgcggccacttcaggccttcgcgcgcggcggcgatttcggcggcgcccagcggcgcgccatggcagtcgtggctgccctgcttggtgggcgcgccgaagccgatggtggttttgcagcagatcagcgtcggcttgccggcgctcttcttggcggtggcgatggcggtggccacttccaccggatcatggccgttgacgttgcggatcacttgccagccgtaggcttcgaagcgggccggggtgtcgtcgctgaaccagccttcgacatggccgtcgatggagatgccgttgtcgtcccagaaggcgatcagcttgttcaggccccaggtgccggccagcgagcacgcctcgtggctgatgccttccatcaggcagccgtcgccgaggaaggcgtaggtgtggtggtcgacgatttgatggccgtcgcggttgaactgggcggccagcattttttccgccagcgcgaagccgacggcgttggtgatgccctggcccagcgggccggtggtggtttccacgcccggcgcgtagccgtattccgggtggcccggggtcttgctgtgcagctggcggaaattcttgaggtcgtcgatggagagatcgtagccggtcaggtgcagcaggctgtagatcagcatcgagccgtggccgttggagagtacgaagcggtcgcggtcggcccaggacgggttggccgggttgtgcttcaggtgatcgcgccacaggacttcggcgatgtccgccatgcccatcggggcgccggggtggccggatttggctttttccacggcgtccatggagaggaagcggatggcgttggcaagctcggtgcgggtaaccatttcggtaaaacctcaagactattgggaaaccggtacgacggctcgtccctgcgccaccatgctgctggagactggggtccaccgccgcaaaaccgccggattatcgccgatttcggcactttcaggcaaccggccgccgcgcgcgcaaattgagtagaatcaagcagaaccatggccggatggcatggtctagctgtattttccccaaaacacggcgccgagcgcgccgccatggagaccgagtatgcagtcattcgacatcccgccacttccccgcaaggtgggcgccggccgcggctggcgctggtgcgtggaggcgttccacatcgtgcgggaacaaccgctgacctgggtgctgctgaccctggtctacctgctgatccatttcgccatcaacgcggtgccgatgatcggcggcctcgtcggcgccatcatcggcccggtgttcgccggcggcttcgtgatggccgcgcgcaagtcggaacgcggcgaggaactggagctggccgacctgttcgccggcttccgcctgatgcccggcccgttgctgcaggtgggcgcgctgttcttcgcgctgatgctggcggcgatgttggccttggtggcggtgggcgcggccagcggcgtgaccagcgggctgctgggcggccatctgcagctgcaggcgcatagcgatgcgctgttcggggtggtgctggcgctggtcggcctgatgacggtggtgatgttcatcgtcagcctgtgctactggttcgcgccggcgctggtggcgctgggcggcgtcgcgccgtggcaggccatccgcagcagtttctcggccggcctgagcaactgggcggcattgctggtggccggcctggccttgtccttgctgggcctgctggctttggtgccgctgggcctgggcctgctgctgtggttcccggtggtctacgtcaccgcctataccagctggaaggacattttcggccaagaggacgcggcgcgatagcgcggcgctttgcgccaagcgaaacgccgtccgctcgacgaggagcggacggcgttttttatcgggacagccgcgcgatcaggcttcggacagcaccagccgcacgctgtgctcctccagcagcttgctcaccggctccggcggcatcgcgtcggtgaacacggtgtggaattcgctgatgtggcccatgcgcaccagcgcgttgcggccgaacttgctgtggtcggcggccaggtagcggtggcgggcgttgttcatcatcgcctgcgccacccgcacttcgcggtagtcgaagtccagcagcgagccatcggattcgatgccggacacgccgatgatcgcgtagtcgaccttgaactggttgatgaagtccagcgtcgccacgccggtgatgccgccatccgacgcgcgcacggtgccggaggtgatcatcgcggtgaagtccgggttggtggacatgatcgaggcgacgtggatgttgttggtgatcacgcgcagccccttgtgcgtcgcggtcagcgcctgcgccaccgcttcgatggtggtgcctatgctcatgaacagcgaggcgtggtcggggatgctgcgtgcgatcatgtcggcgatatgggccttttcgctctggaattttcccttgcgcgcaaagtagtcctcattctccacgctgttgcccagcgcggcgccgccgtggtagcggcgcagcaggttggcctcgcacagctggttgatgtcgcggcggatggtttgcggcgtgacgtcgagcagacgggccagctcttcgatcggcatgaagccgttttcgcggaccagttgcaggatcttgtcgtgacgtggagagcggctcataactattcggaatcgaaaatcacgttactttagtaacatatttgccccccggatagcaaatgccggctgcaaattccgccgcgccggctcagtgcgcgatcaccaccttgcccaggttgcggcggctggcgaaatgctcccaggccgcgcgggcgtcgtcgaaggcgaacacgcggtccagcgccggacgcagccgatgctgctctatcgcgcgcaacatcgcttcgaatccttcgcggtggccgacggcgatgcggcgcaaggtggcgccgctcaggaagaagcgcatgaagtcgagcggggccgcgccttcgtccagaaagcctatcaccgcgatctcgccgccgatggccgtcgcctgcagcgactgctccagcgtgccttggccgccgacttccaccacccggtccacgccgcggccgccgctcagctcgcgcgccgccgcgccccagtccgggctggcgcggtaatctatcacctcgtcggcgccaagctcccgcagccgctgcgccttgtcggcgctggaagtggtggcgatcacgcgggcgcccagcagcttggccagctggatcgcgaacagcgacacgccgccgctgccctgggtcagcaccgtgtcgccggccttgaccggctgcggcccggtcagcgcggtccaggcggtgagcgcggcgcagggtagcgtcgccgcctcggcccagtccaggtgatccggcgcgcgcaccagcgcctcctcgctcaccgccttgtactggcacagccagccgtccaggttgctgccgtactggcgcgcggcctgcggcggcggaaacgggccgccgaaccattccgggaaaaaggtgttgcaaacccggtcgccgaccgcgaagcggcggcagtcctcgcccagctcgacgacttcgccggcggcgtcggacagcgggatcaggccgtcttgatggctcatcggatagcggccgttgagcagggccagatcgcggtagttgagcgcgctggcgcgcacccgcagcaggacttcgccgcggccggggcgcggcatggcgtcgtcgcggcgttgcaggtggtcgagatggccgaagcgggagaaacggtagctttgcatggggaaagtcctgatgcggtgggaatgccgccatcttgccgcgccggcttgatatgatgaatgctttgaaacgccgttctattcaccattcgtccagacttcaggaaaagcgcatggacttgctggaagacattttcaccgcgatgcaggtggagagcgcgctgtacgcgcagctggaggcgggcgcgccatgggggatcgcgttcagcccgcacgcgtcggcccgtttcggcatcgtcagccatggccgctgctggctgtccggcgccggcctggccgagccgctggcgctggccgccggcgactgcttcatcgtcagcggcggcagccctttcacgctgatggaccagccgggacggccggcggtgccgtgcgagacgatcttcgccggccgcaccgaaggggtgatccgtttcggcggcggcggcgaggaaaccgccatcgtctccggccgcttcctgttcgacgccgccggcggcgcgccgctgatggacctgttgccgccggtgctgcatctgcatctggacgacgagcacgcccgcctgctgcaggcgacgctgcagctgatcgcgcgcgagaacgccggccaggcgctgggcgcgcggctggcggtgcaaaagctggtggatgtgttgctgatccaggcgctgcggatcttctgcctgggcggccagggcggcggctggctggcggcgctgggcgaccgccacctggcgccggcgctgcaggcgctgcaccgcgatatcgccgcgccgtggaccgtggcgcagctggccgggctggccggcctgtcgcgctcggccttcgcccgccatttccgccaactggtcggcgacacgccgctcaattacctgaccggctggcgcgtctaccgcgcgcaaaccctgctgcggcaaagccggctgccgctggccgaggtggcgcagcgggtcggctacgacagcgacggcgccttccagcgcgcgttcaagcgcgtttgcggcgtgccgccgggcgaataccgccgcgccagccggacgggctgactcaggcgcaggcccgggcgatcgcggcctcggccagcgccagcgtggtgtctatcgccggcacgccgcaattggcgtcgttcagcgccagcggcagctcggtgcaggccagagccacgccgtcgcagccctgcgccttcatcgccgccactacctgcagcagcgcggccagcgtggcctcgctggcgcggccgctgggcaccagctcttcgaaaatggcgcgctggatcaccgcctgctgcgcctcgtcgggaatcacttcctcgatgccgcgcgcggccagcggcgcctggtacagatgccgggccatggtccagcgggtgccgaggatggccacccgcttcaggccgcgggcggcgcaggcgtcggccaccacgtccagcatgctgatcagcggaatcggcgagcgcgcgcggatgtcttccaccaccaggtgcacggtgttggcgggaatcaccgccagtgcggcgccggcgccggccaggcgttcgagcgagccgacgatggagtcggcgaccttatcccagcggtcgtcgtcctgcgcctggtgcaccacgccgaaatccggctggtccagcgcgaagcgcgggtgatggtgggcggcgaagcggccggcgcacagccggtgcatcttggacaggcagtctacggcgccgggcacggtgacgccggcgatgcctatggtttttgcgtgcatgttctgctcggtgggtggcgtgtggtcaagagtcggcaagctagactttcgtcataaaaaagtcaattgctcgtaccttgttgccaggtgtcgccggcgcgcaggcgctggatgaactcctccagcggcatcggcctggcgatgtgatagccttgcagccagcccacgcccagctggctcaggtagtcgaattgcgcctgggtttccacgccttcggccaccgtttccaggcccaacttggccgccagctcggccacgctgtcgacgatgtgggcggacaggccgtcgctgccgatgccggcgacgaagccctggtctatcttcagcccgtccaccgccagttgctgcagatacaccaggctggaatggccggtgccgaagtcgtccagcgcgatcttgacgcccagatcgtgcagcttctggaacagttccgccacttcaggcgtgatttcgacgatttcgcgctcggtcagctccagcgtcagcgccgcctggctgccagccagcaattgctgcagctcttggcaatcggcgtagaagtgggggtcatgcaggtgggcgcggctgatattgaagcccagatggaaaccggccggcaacggctgttgccgcagccggcgcgccacctgcttcatcatccgccgcgtcatcggcacgatcatgccgctttcctcggcgcggggaatgaacaggtcgggccggatcagcccctcgcggggatggcgccagcgcatcagcacttccgcgccctgccagcccggcgcgccgggcttcaccaccggctgcagaaagccttcgaattcatcattggccagcgcgcgcttgagctcgtcggtgggcgaggccggccggcccaacagccagtacagcgtggcgccggcgagcaggcccagcaaggccagcgtcacggtcagcgcggcgtggtcgtcccacagcaagctgtgccagggcggcatgtcgtagcctgtcaccaccgagtaggggtaaaccgacgaatgcgcggtggcgcggaatctccaggccagcggcgcctggccgtcgccggcgaggcgcggccctatccattcgtcgcctatctgcatgaacaccggattgctgtcgctggcgtcttgcagcgccagttgcaggtagcggccgtccaccgtggccatcgcgtcgccgcccgcgccttgcagccggtagtacagcagcggcacgccgggcgtgatcttgttgccgtgggtcaggttcagccgcttgtcggtgaagtcgcgctgcggcatcgcgatggcgacctggccggacaccgaggtgcagtacatcaggtcgccgcgcgccaacgacaggctgcgcacgaagggggaggcggcggtttgccgccgcagcgcgtattcggcgtcggcgcatgcgccgccggccagcggcaggatcgcgcgggtggcgcgggcggcctcgtccaggatgtcgtccaccatggccacgccgtgccgggtttgctgctgcgccgtctggcgcaggtcctgctgttcttgccataccagcgccggcgcggcggtcagcaagggagtcaggcagaccagcagggccagcagctggtgggacagccggtgttggcggcgcgggtgcagggggttcatcgggtctccagggcgggcggcgccaatatgcgcctagtattgaatgtttataattttcgccttattttaaacaaaaatgcaaaaggccctccgtttcggagggcctggtcactgggcctgggccgggacgggctgtttcagcccagcctgccgcggtggcgggcgatctgcgccgccacctgcgccggggcggtgccgccgacatggtcgcgctgggcgaggctgccctccggcgtcaatacggtatagacatcatcggcgatcagcgcactgaagccttgcagcgccgagagcggcagctcggccagatccacgccctgccgctcggcgtggcgcaccgccagcgccaccacttcgtggctgtcgcggaacggcaggcccttcttcaccaggtagtcggccaggtcggtggcggtggcgtagccctgcagcaccgccgcgcgcatcgcctccggcttcaccgtgatgccgcgcatcatgtcggcgtagatgcgcagcgtggcctgcagcgtgtcgacggtgtcgaacagcggctccttgtcttcctggttgtccttgttgtaggccagcggctgcgccttcatcagggtgaccagcgcgatcaggtggccgaccacgcggccggacttgccgcgcaccagctccggcacgtccgggtttttcttctgcggcatgatggacgagccggtgcagaagcggtcggcgatgtcgatgaagccgacgcgcgggctcatccacaggatcagctcttccgacaagcgcgacaggtggatcatcaccaaggacgccgccgcggcgaattcgatggcgaagtcgcggtcggacaccgcgtccagagagttgtggcagacgtcgtcgaagcccagcagctgggcggtgtagcggcggtcgatcgggaaggtggtgccggccagcgccgccgcgcccaagggaagccggttgacgcgcttgcggcagtcctgcatccgctcggcgtcgcgcgccagcatttccacataggccagcaggtggtggccgaaggtgaccggctgcgccacctgcaggtgggtgaagccgggcatcacggtggcggcgtgctgttccgccaggtcgagcaggctcttttgcagctcggccagcaggtggacggtggcgtcgatctcgccgcgcagccacagccggatgtcggtggccacctggtcgttgcggctgcggccggtgtgcaggcgcttgccggcgtcgccgatgcggtcggtcagccggcgctcgatattcatgtgcacgtcttccaggtccacgctccatgccagctcgccggcgcggatctggtcgcggatttcggccatgccctggcggatcgccgccaggtcggcgtcggacagcacgccggatcggttcagcatcgcggcgtgggccagcgagccttcgatatccacttcggccagtcggtagtcgaaaccgatggaggcggtgtagtgcttgacgagttcggataccggctcggaaaagcggccggaccaggcgtgttggtcttgcatggcgttgcgtcccactggtgatagtgcaaagaccctactatgccagccgcaaccgctcagggccagcttggttttcgccggcgccctcagcgcggggcggcggcggccggccgcaatggcagcccggccaggatgcgggcgacgctgccgtcgtccagcatcgcctgcagcgcctgcgagacgcgggccttttcggcgtggaacggcgagttttgcgccagcgccagccggtgcgggcgcaggtcgtccagcgtcaggccggcgcgccgcacccggccggcgaattcgtggctggccgccagcaggccggtctgctgctcgttgccgatcagcacgtcgatgcggccggcggccagcttgcggaagctggactccatcgtcagcgcggtgtcgcggcgcaggcgcccgtcctggtcgaaagcttcctggtattgcacgccctccaccacgcccaccgtcagcggcagcaggtcctggtagcggcggatcacgcgcggatcgttgccgcgctggtacagcgccagccggttgccgctggcgaagggcggctccaggtagtccaggtagcgggcgcgctgcgggctgtgctgcacgcctatcatcaggtcggcccggccctgctgcatggcggccaggcagcgcggcagcgggcagttgaggaagcgcagcggcagccgcaggcggcgcgccagctcgcggacgatttcggtgtaagggccggagggctggccctggccgtcgtagtttttccacggcgcgaaggcgttgtaggccagcaccagcgggcgcggtccgttgtcggaggcgagcgccggctgggccagcagtcccaggcaggacagcaacagggcaagcagtgtcttcacggcggctttgcttggaaatgttttcagcaatcctaactgctaatcggacagggcaacatgtttgtcgcggcttggcttcggcgctgttgcaaaaacgacgcggccggcgggcggacgcgaaacagcccgcgccgtggcgcgggctgtgtccgggcgggagcggggccgctcagtgctgcaggatcttggacaggaactggcgcgcgcgctcgctgcgcgcgtccaggtcgccgaagaattcgtcctttttgcagtcctcgacgatgcggccctggtccatgaagatcacgcggtcggccacgcggcgggcgaagcccatctcgtgggtcacgcacatcatggtcatgccttcctgggccagctcggtcatcacgtccagcacttcgttgatcatctccgggtccagcgcgctggtcggctcgtcgaacagcatcgcgatcgggtccatcgccagcgcgcgggcgatggccacccgctgctgctggccgccggacagctggccggggtgcttgccggcgtgcgccttcaggccgacgcggtccagcagcttcaggcccttggacatcgcctcctcgcggccgcggcccagcaccttgacctgggcgatggccaggttttcggtgatggacaggtgcggaaacagctcgaagtgctggaacaccatgccgacgcggctacgcagcttgggcaggtcggttttcggatcgccgaccgaaatgccgtcgacgacgatctcgccctgctggaacggctccagcgcgttcacgcacttgatcagggtggatttgccggagccggacgggccgcacaccaccaccacttcgcccttggatacctgggtggtgcagtcggtcagcacctggaagctgccgtaccatttgctgacctggttcagtgaaatcattgcgctcatacagccaatccttgttgcaggcgcttcaccagccgggaagcgccgaagctgatcacgaagtagaccaggccggcgaatatcaggaattcgtgcggcaggccgacgatgtcgcccttggagcgggcggtgttgagaaagtccatcaggccgacagcgtataccagagacgtgtcctggaacaggatgatggactgctgcagcagcagcggcatcatcttgcgcagcgcctgcggcagcaccaccagcgccatcacctggtggtagcgcatgcccagcgcgtaggcggcggcggcctggcccttggggatggactggatgccggcgcggacgatctcggcgaagaacgccgcctcgaacatcacgaaggcggtgaggcaggaggtgaacgcgcccaccggctccaggctgccggtcagccagttgatcaacagcggcaccgccaggtagaaccacgagatcaccagcagcagcggaatggagcggaaatagtagacataggcggtggcgaagccggccagcagcttgttgccggacaggcgcgcgagcgccagcaggatgccgagcagcacgccgccggccacgccgccgaccagcagcttcaaagtcaccgccatgccctgcgacaggcccggcagcgccgggaggatttggctgaaatccatcatttgcctcccatcgtgccgggcacgcgcagtttcttctccagcgcgttcatcgacagcatcagcgccatattgatgacgaaataaatcaccgtggccagcgtgaaggcctcgaacagattggccgagaattcggcggtctgcttggtctgcgccaacagctcggccaggccgatcagcgacgccaccgacgagttcttgatgatgttcaaaaattcgctggtcaacggcgggatgatgatgcgcatcgcctgcggcagcagcacgtggcggtaagtctggcccaggccgaagcccatcgccatcgccgcgttgcgctggccgatgggcagcgcctcgatgccggtgcgcacctgctccgccacccgcgcggcggtgaacaggcccaggcacaccaccaccgacaggaactgcgaggtggtcggcgacaggtcctgcttgaaccaggtttgcgcggcttgcggcagcaggtccggcaccaggaagtaccagacgaacagctgcaccagcaagggcacgttgcggaacaggtcgacataggcggtggcgaggcccgccacccagcgattgggcagggtgcgggccacgcccgcggccacgcccaccaacagggcgatgacccagccggtcagccccaccgccagcgtccagcccaggccgctgacgaaccagttgaggtagatctcgctgccgacgccggtcggcttgaagaacacgccccaatcccagtggtaattcatgatgccactccccagccgcgccgcaggatgcggggcgcggctatccatgccccccgccggctggcgccgggcagggtgaaaccgccgcccgcggcgaacgggcggctgcagtcgctatttcaagccgaaccggccgccgggcggccggattgcggcttattcggcgggcttgtccgtcggcttggccagcagcgccttcagctcgtcggacatcgggaagttgaggttcaggcccttgggcggcaccgggctggtgaaccacttggcgtagatcttgttgacttcgccggacttgaaggtgttggccagcgcggtgtccaccaccttcttgaaggccgggtcgtccttgcgcagcatgcagccgtagatctcatacgattgcgatttgccggtcaccgtccagttggccggattcttggccttggccatttcgccgtacagcagcgcgtcgtccatcatgaaggcgacggcgcggccggactccagcatcaggaacgattcgccgtggtccttggccgaaatcacgttcatgcccatgttcttgctggcgttcatcgccttgatcaggcgctccgacgtggtgccggcggtggtgaccacgttcttgcccttcagatcggggaagtccttgatgccggaagtcttggcggtcaacaggcgggtgccgatctcgaagatgccgaccgagaacgccacctggcggccgcgctcggcgttattggtggtggagccgcactccaggtccacggtgccgttctgcaccagcgggatgcgggtctgcgaggtgaccaggttgtagcgcacctgcaggttcggcattttcagctctttcttcacctcgtccactaccttgttggccaggtccaccgaatagccgatcggcttctggttgttgtcgtagtaggagaacgggatggaggaatcgcggttgcccagcacgatcacgccggagtccttgatcttcttcagggtgccggtcagttcggcggcggaggcggtttgcgccgccagcgctgccagggcggcgatggtacatccggcgatgacggaggtgcgaatgcgcatgagtgtttctccttatgactctctttgcgggaaaagcggcgccgccgtagacagcggcgccttgatcttctttgtagtgattgtccgacagtatgctgttatttttggtcggcgtcaggccttgacgcccttgtcggacagatggttggccaggcggacgtagtcttccaccgccaggttctccggcctgaggcccggatcgatggccagcgcttccaggtcggcgacgtcggccaggcccttgaggttgttgcgcagcgtcttgcggcgctgggcgaaggcctggatcaccagtttttccagcagcgcctcgtcgcgcgccacgccgcagcggcccggcgccgggatcatccgcaccacggcggagtccaccttcggcggcggccagaacgcttccggcggcacgaacaggatgttttccatgtagaagcggtattgcagcatcaccgacagccggccgtaatcggcggtggagggctcggccaccatccgctcgatcacttccttctgcagcatgaagtgcatgtccagcacccggttgccgtaagtggccaggtggaacagcagcggcgtggagatgttgtacggcaggttgccgacgatcttcagcggcgccgcgctgaccgagccgaaatcgaaggccagcgcgtcgccggcgtggatggtcagcttgtcggccgggtgctcggcgcgcagccgctcgatgatgtcgcggtctatctccaccacgtgcagatgcttgaggctggacagcagcggcttggtgatggcgccgaggccggggccgatttcgacgacgatgtcgtccggctgcgggttgaccgcatggacgatgctggcgatgacgccggcgtcctgcaggaagttctgcccgaaacgcttgcgtggaatgtgcttgctcatgaatctgccaaatcttggaacagcggggattgtaaaccttgcacccgcaaatgtcccatgcgattcaggcagttggcgtcaggccttgcgctgcaggaacaggcatagcagcgacagcgcgaccaccgcgccgcccagcgccgtctcgcccgccaccggcagcgcggccagcgtggccgacagcaccgcggcgaacagcatctgcacgcagcccaggatggcggcggcgcggccggcggcttcgccgaacggcgccatcgccatgccggcggccggccccagcgtgcaggcgaagcccacgctcagcaccgccaccggcagcatgtagtgccaggcgccggcatggccggccagaatcagcagcagcgcgccggccgccagcatcaccaccaggccgcttcgcagcaccgcgcgctggccgaagcggccgatcagcgccaggccgatgaagctggccgccatgatcagcagcgcgttggcgccgaacaacaggccgaaggtttggctggacagcccctcgcggccgatcagcacgccgggcgccagcgtgacgtagctgatgatcaggcccagcgcggtgctgccgcaggcgccgttgcgcagcatcgccggatggcgcagcaccgcggcgaagccggggccggccggtttgtcggtccgctccggccgggtttccggcatcagccagtacagcgcggcgaaggccagcagcgccgccgccgccaggaacacgaagcaggcttgccagccataggcgacgctcagccagccgccgcaggccggcgccagcgccggcacgatgttgagcgcgccgttgagcaggctgtagcgctggccggcggcgttgccggagaagcagtcgcggatgatggtgaaggcgctgaccgtgctggcgctggcgcccagtccctgcagcagccgcagggacaggaacagtggcagcgaatcgcagcggctggccagcagcgcgctggcggcgtagaccagcaggccgcccagcgccaccgggcggcggccgacgcggtcggccagcgggccgaacagcaattgccccagccccaggctgaacacgaacacgctgatgctggccgccgcgtcggcctggaagaactgccgcatcgccggcagcgccggcaggtacaagtctatgcccagcggattgaacaggatcagcaggatggcggcggcggtggccgggttggcctggcggacggcgagactggtgggcgacatggcgggcctgcggcggaaaaggcgctcatcataacaaatgccatcgccaaaccctaatttgccatttgaatatttggttaatgcattgtttcctttgtcatttaatcgctgggcgaggcttgccgggcgcttacaatcgttcactatttattacgcgccgcaagcggctgtttccgcagcgcttttccatcggcggcgacggccgcgccgcactagtgatggttgccggatggccgctctggtaacctaggcgacagccaaagaacaaacgagcagccagacatgagcaccaatgacacccgaatatacctggcctccggcagcccgcgccgccgcgagatactggaacagctgggcctgcatctggaacgcattcacgccgacatcgacgaatcggtgctgccgggcgaggacgccgtcgcctacaccgagcggttggcgcgagaaaaagccgaagccggctggaaagtggtttcttcctgcggcctgcccgaacgcccgctgttggccgccgacaccacggtgacgcaggacggcgagatcttcggcaagccggcagacgccgacgacgcccgccgcatgctgcgcgccttctccggccgcagccaccaggccatcaccagcgtcgccgtgatgcgcggcgccaggctgctcgtcaagacttcggtcaccgatgtgttcttcaagccgctgtccgacgccgagatcgaacgctacctcgccagcggcgagccgttcgacaaggccggcgcctacggcatccagggcaaggccggggtgttcgtcgagcatatcgaaggcagctacaccggcgtgatgggcctgccggtccatgaaaccgcgctgctgctggccgaattcggcttcgagctgccataagccggagggggaccacatgctgcatcaatcgatagccttgccgcgcgacctgccgcggccgcaagaacagatcctggtcaacatcacgccgcaggaaacccgcgtcgcggtgctggaagaaggcatcgtccaggagctgcatgtcgaacgcgccgccagccgcggcatcgtcggcaacatctacctgggccaggtgaagcgcgtgctgcccggcatgcaaagcgccttcatcgagatcggcctggagcgcgccgccttcctgcatatcgccgacgtgctggaacagcgccagcacccgaccgagccgcagcgcatcgagaagatgctgttcgaaggccagaccgtgctggtgcaggtgatcaaggacccgatcggcaccaagggcgcgcggctatcgacgcagatttcgctggccggccgcttcctggtgcacctgccgcaggaagagcacatcggcgtgtcgcagaagatagaaagcgacgccgagcgccacagcctgaaggcgcggctggaaaagctgctgccggacggcagcccccggggctacatcatccgcaccagcgccgagaccgcccgcgacgacgagctggcggccgatgtggaatatctgtccaagctgtggaccgacatccgcctgaagtcgcagacgctgccggcgcaaagcctgctgtacgacgatctgccgctggcggtgcgggtgctgcgcgacatggtcagcggctacaccgacaaggtgctggtggactccaacgagaactacggccgcatggtggagttcgccgagcagtacgtgcagatcgccgtcgacaagatcgaacgctacgccggcgagcggccgctgttcgagatgcacggcatcgaggccgaaatcgacaaggcgctggcgcgccgcgtcaacctgaagttcggcggctatctgatcgtcgaccagaccgaggcgatgacgacgatagacgtcaacaccggcggcttcgtcggcaaccgcaacttcgacgaaaccatcttcaagaccaatctcgaagccacccaggtgatcgcccgccagctgcggctacgcaatctgggcggcatcgtcatcgtcgacttcatcgacatggacaacgacgagcaccaggcggcggtattggccgagctggccaaggcgatggcgcgcgaccgcacccgggtgacgctgaacggcttcaccagcctggggctggtggaaatcacccgcaagcgcacccgcgagagcctggcccacgtgctgtgcgagccttgcccgacctgccagggccgcggcgagatcaagaccgcgcagacggtgtgctacgaggtgcagcgcgagatcgtgcgcgaggcgcggcagtacgacgccaagggctaccgcatcctggcggcgcagtcggtgatcgacatgttcctggacgaggaatcgcaaagcttggcgatgctggtggacttcatcggcaagccggtgtcgctgtcggtggagtccagctacacccaggagcagttcgacgtggtgttgttgtgagctagcgccgggcgcgcttggcgcgccgcggcgacgcgaaaacgggcagcggccgcgaggcctctgcccgtttctcatgcggcgaacgcctgcggcttacatgcgggccagctgttgcttggccttttgcgcggcgtcgctcttcgggtacagcttgatcaggcggcggaaagtgtttttcgcctggtccacctggcccagctcgcgctggcagttgccgatattgcgcagcgcgtccggcgcgaaatggtggccggggttttgctcgacgaagcggcggtggatgtcgatggcggcgtcgtactggcgcagcgcggtatgggcgacgcccagccagtagctggcctcgaccgcttgcggcgcctgcggattctgctggatgtagaggcccagcgcgttgatggcgttggggaagtcgcgcgcgcgcagcaggttcagcgccttgtcgtagtcggggctggcctggctgtcgccggcggcggcttgccgggcggcggccggttgcgaggcgtcctgcttgccggcgccctccagatgggacaggcggccgtccaggtcgttgtagaggtcgttctggcgcttctgcgtggtttgcagattgtagttcagcacttcgatgtcgccgcgcagcttggcgacttcggccttcaggctgtccacctggctgaccatttccagcaacttgtcgttggacagcttggtctccaccgcggcgatgcggttggtggcctgttgattcaccaggtccagctggcggcgggtggcttccaggtcgctgttgctggcgcagccggccagcgtcaacagcagggcgctactgatggcgatgcggttcatgggctttccgatggaggaagactgccggatatcatagcggcttggccgccgcttggcacccggcagcggaaacgacggcggacggcccgcgggccgtccgcgtcaggcgcttactggccctggtagacgatgtcggcgcggcggttttccgcgtagtcggcgtcagacgtgccggtagccttcggcttttccttgccgaagctgaccgcttccagctggttctccttcacgcccagcacttccatcgcgtgcttgacgctttcggcgcggcgctggcccagggccaggttgtattcgcggctgccgcgggcgtcggtattgccctggatgatcactttcttgtcgtggcccttcaggtagtcggcgtggttggcgacggtgttcttgccttcgccgtcgacggtggaggagtcgaaggcgaagtagacgctgcgcttggccagcgggctgttcggatcgttcagcggatccatcgccacttggccctggttgctggcggaggtgtctgccggcgcctgggtgaccggcgcctgggcggccggggctgccggggcttcagcgggcttggtgctggcgcaggcggcgagcagggtggcgaccgcgctgccgaggacgagttgtttccagttcattgttggctccctcaaggattgttgaatggaccccatgccgggtcctgcacatcgccattgagcaccgccagcttcactttgctgctgccgtccgcggtggccgcgtacagcacgctgcggccgccgatatcgctggagtacagcaccatgcggccattgggcgcgaagctggggcgttcgctgtaactaccatctgacaatagacgcgtgtcattagttgcgagatcttgcgacatcacgcggaaatttccggcttcgcgacggatgtagaccagggtcttgccgtccggcgacagcttgggagacacgttgtacttgccttcccaggtaacgcgctgcgcgtcgccgccgtttaccggcacgcgataaatttgcgggttgccgctgcggtcggagacgaaatacaccatcgagccgtccgggctgaacgccggctcggtgtcgatgccgccgttgtacatcagccggcgcgggctgccgccggcggcgttgaggatgtagacctgcgaattgccgctggtggtcagcaccaccgcgagcttgctgccgtccgggctccaggccggggcggagttgctgcccttgaagttggccaccgcgcggcgctggccggtggccagatcctgcacccacaccaccggtttctggctggcgaaggaaacgtaggcgatgtagcggccgtccgggctccagctgggcgagatgatgggctcgctggagcgcaggatggtctggctgcgctggccgtcgacgtcggaaatctgcagcgcgtagctgcggccggatttcagcacgtaggcgaggcgggtgttgaagaagcccttctggccggtgatcgcctcgtagatcatgtcggcgatcgcatgcgccacctggcggctgcggtccggcgtcactgtgaattcgccgccggtcagctgcttgcgctgcgacgcgtccatcaggcggaagctgatcttcagctggccgccagcggcctgctccaccttgccgatggcgatggattgcgcgccggcggcctgccacagcgggtagcggatgtcggccggctcgaacggcacgttggcgacggcggacgggtccaccaggcggaaggcgccggacagcgccaggtcgttgcctatcaccggggtgaggttgccctgggtgggcgcctcgtccttgaacggcacgatggagatggcgtggcggctgttgccgccgccgatgatttcgatattcagctcggcgcgggcgctgccggcggccagcatcgccagcagcagcatccccttcagtacagttcgcaaactcggcatgtcttcctcgtgacaggggtggcgccgcccgctcagtgcgggcggaaggtcagggtaaaggttcggtagccgtcgttgaagttggccccggcgggcagtttggggaaggttttcgcctcccagaccgctctttgcactgcatcatcataggccgcctggccgctgcttttcaccagctgcacggttttgacttccagggtgggcagcagcgtgatccgcagcaccaccgccggattgccctggatgccgggcggaatctgcaccagcggggtgaccttggccttgaccatgtctatccagccggcgttgactccggagccgttgaccgcgccgccggccacgccgtgcttgctgccggcctggtcgctgcgggcgttgggcttgccgctgacgcgggtgctgtccaggctggcgagcaggtcgtcggcctcgttgttgtaggttttgtccggtttatggccgtgcttggccggcggcggcggggtggccttgacgggctttttctcttcgaccggcttgggcttggcctgctccgccggcttgggtttgggctcgggctttttcggctcttccggcttggccacgtgcttcttcgcctccggcttgggctcttccgcgggtttaggcttttcttccttcttcggcttcggcgcgtccttccggcccaggttcacctcggccggcggcgccgcgaccaccggcgcgggtgtcggcgcaggcgtaggctcaaccggaaccggcgtcgctgcgggcggcggcggcgcggtggtccacagctccagcgccagcggcgccgggctgggcggcggcgtggtctgcaggccgccccacagcaacaggccgatcacgatggcgtggaacagcgccgaggcgatcagggtccaggggcgcagggaggagggcgattgcgaactcattgcttcggcgtttgcttgacggtcaacgccacgcgcttgacgccggcctggtgcaggcggtcggctatccgcaccacctcggcgtatttgaggttggcgtcggcggagatggccaccgggcgcgggttctcgcccaccagcgcctgcagctggctggccaggtcatctagcgaatcgacgcggctcttctgctcgccgtccaccagctcgatcttgccggtggcgtccaccgtgacttctatcggccgcacgtcgatggctggcgcctctgaaacactgggcacgtcgatcacgccgggcgtgaacatcggggcggtgaccatgaaaatcaccagcaagaccagcatcacgtcgatatagggcacgacgttcatctggttcatctggcggcggggacggcggtttagcatgacggattctggctcggctcggtcaaacggtcatcatagcatcgtcaattccaacgatgctgaggccaaaaggtttcagagtgtttgctgctctggaaagttctaacgccgcaatcagcgccgcgtgcacagcgtcaggccgtcgcccaccggcagcacgcacatgtgcacgcgcgggtcggctttcaggctggcgttgaatgcgtgcaccaggtggacgccgggcgggtcttccggcttgggcgccaccacccggccggacaggaagatattgtcgatggcgatgacgccgccgggacgcaccagttgcaggcaggcttcgtagtagtcgcggtaggacggcttgtcggcgtcgatgaaggccaggtcgaaactgccggcccggccgtcgtccagcagtgtttgcagcgtattgagcgccggctgcagcctgaggtcgatgcggccggcgacgccggccttggcccagtattcgcgggcgatggcggtgaaggtgtcgctgacgtcgcaggccaccacttcgccgtcttccggcatcgccagcgccacggtcagcgcgctgtagccggtgaacacgccgatttccaggtagcggcgcgcgccgatcagccgcgccagccagcccatgaactggccttgctccggcgcgatctgcatcttggccagccggtggccggcggtgaattcgcgcagctcgcgctgcaccgggtgctcggctacgccgatgttgaacaggtaatcgtgcagggcgcggtctagcgccacggtgcggctggtcatgactgggcttccggaaagacaaaacgcccgctgggggcgtttggagacgggcggcggcggattattccggctggtagacgtaaggcttttgcggcacttgcgattctttccagcggcgctggtcttccaggttgggctggcggtcccacagggtcaggcgcagttcgcggcgctggctgtccacttccgggtttttctccaggaagccattgatgaactgggtgaattcggactggtacatcgtaccctccatggtggctgatgcgtcgattttaatcgattccgccggccgccgccatgccgcctcagtccggctggccgtcgccgtacagcaggcattcgatgcgccggtcgggaatcagccaggccagcgccaccgccaggtacagcaggccggacagccagggcaggcgccaggccaggcagatcgccagcaggtagcagaccggcgagatcttgcccttgatgtcgccgcccagcgcctcggccagccgggtgcggttgccgggcaggcacagcagcgcctgctgcatgatccaccaggcgatcgagcacatcagcagcaccgcgccgtacagcgccaccggcagcggctggaaatggttttcgcccatccagccggtgacgaagggaatcagcgacagccagaacagcaggtgcagattggcccacagcacccggccgtcgatgcggcgggtggcgtggtagaagtggtggtggttgttccagtagatgccgacatagacgaagctcagcaggtagcacaggaagatcggccacagctgcagcagcgcggcgaaggtggtgtcgtgcggaatatgcagatccagcaccatgatggtgatgatgatggcgatcacgccgtcgctgaacgcctccaggcggtttttctccatgcctcgctcctcgtgttttgcgccgcgccttgcaagcagcttagccgttccgctccggcttgccggcgcggcggtagggcaggcggatccgcgtcaggtagcggtcgccgcgcagctcgccggtcagcgaggcctcggcgtcgaagaacagcgccagccgctcgcgcagattgctcagcgccatccggttgccgcctggccgcggcgaggccggcgccggattgtccagcgtcagctccagctggccgccgtagaggcgcgcgccgatgacgatctccacctcgccgcccgattgctcggcgccgtggtagaccgcgttttccgccagcggctgcaggatcagcggcggcatcgcggcgtccagcggcgcctccacccgccagctgatcttcagccgcggccccagccgctcgctttctatcgccagatacatgccggccagctcgatctcgcgcgccagcgtggaggcgcggtcggggtcggccaactgggcgcggaacagctcggccaggttttccagcaccgtctcggcctgctgcggctgagagcggatcagcgcgatggcggcgttcaggctgttgaacaggaagtgcggtcggatgcgcgcctgcagcgcggccagccgggcttcggccagcgccggcgacagcgcgcgctggcgcagcgacagatagtgcagcagcagcgccatcgccagcatcgccagcgccggcgtccgccaggcgaaaggcgcttccggctgcagccgccattggcagagcgcgaagccggcgccggtcagcgcggtggcccagctcgggcccagccgccggcgggccagccaggggctggccagcgccagcagcgccagcgaaagcaggctgccgggcagcagcagcagcgctagctgcagccagcgccatagcggctccgccgtcggcggcgccagcaggccgtagatgaataacagcgccagcggcagcagcaggatgcgcagcatcacgcctagattgcggaagtccggcagcggcgtcggaatagggctgggcatggcgggacacgggaaggggcgatgctgcgatcatagcaagcggccggcggcgcggcatccgccgccggagaaaagcgccggcgcggtgtataacggaagcggaagatgcggggaggggcggagcgatgaaatcgatgctggcctgcgcgcgcgcgctgttgctgggcctgtgggccggctgggccggcgcggccgaactgctggtttccaccggcgaatacgcgccgtggagcggggcgcggctgccgggccagggcttcgtcaaccgggtggtgcgcgaagccttcgcccgcgagggcgtggcggtgcgcttccagtacctgccgtgggcgcgggcgctggaggcgctgcgcaacggcagcgtcgaggccagctctttctggttcgacgatccgggcaaggccagggagtttctctacagcgcgccgttgtcggagcaccgcgaactgttgttccaccgcaaggacctagcggtgccggcgtgggcgcggctgcaggacctgcacggcctgcgcttcggcgccacccgcggctattcctacaccgccgagttccgtcaattggcgaagcagggcgccatcgaggtggaggaagcggacgatgacaagaccaatctgctcaagctgctggccggccgcatcgagctgtttccaatagacgaattcaccggttggcagctgctggcgtccgacacctttccgcgcggcgcgcacgacctggtcaccaccgagccgcggccgttcagcactcagtacggccacctgctgatgctgcgctccgcccgcaacgagcagctgatgggccgcttcaacgccggcctggccaagctgcgcgccgacggcacgctggagcgcttccggctcgacctctaccgcggcagcggcctggggccgtgagcggcgtctgatctggcgcaaggcgttgccattttcgcggctttcccgtctttacagcgcggcgcgcttttcgctagtgtcgattattgcgccgcaatatcagattgttcttattttgtgggattttccacaccttgccgccgctgccgcgccttgtcatcggcatggcatatcgagctgctgcaatgacggcaaggcttgatgactttggcatggccatgtccgatcgcccagttgaggctgccgtgtccgacgatatacggtagtcaatatatgccttgcataacgcggcgcagcatgcttctaatcattttcaaacggccgttctaaattgcgccgcgcggcggtttcaagctactgatttcacaattccataccaggagacacgcagatgcatatcgtcatcccagccgaacggctggccggtgaacgccgcgtggcggcgacgcctgacacggtgaagaagctggtcggcgccggccatgccgtcacggtggagcgcggcgccggcatcccggccgccatccccgacgccgcctacgccgaagccggcgccaagctgtccgaccagcgccaggcgctgctggcccaggccgacatcgcgctgacggtgcgcatgccggcagccgccgatctggaggcgctgaaacccggcgcggcgctgatcggcatgctggcgccatacggcaaccccctgctgccggagctggcggcgcggggcatttccgccttcgcgctggagctgctgccgcgcaccacccgcgcgcagagcatggacgtgctgtccagccagaacaatatcgcaggctacaaggcggtgctgctggcggcggaatactacccgcgcttcatgccgatgctgatgaccgcagctggcacggtgaagccggcgcggctgctggtgttgggcgtcggcgtcgccggcctgcaggccatcgccaccgccaagcggctgggcgcggtggtggaggcctacgacgtgcgtccggccacccgcgagcaagtggagtcgctgggcgccaaattcgtcgaggtgccgatgacggacgaggagaaggcggccagcggcggcgtctacgcccgcgagatgaccgccgaattcctggcgcggcagaacgcgctgctggccaagcgcgccgccgcggccgacatcgtcatcaccaccgcgctgattccgggcaagccggcgccgcggctgctggatgccgccgcggtggcggcgatgcggccgggttcggtgatcgtcgacctggcggcggaagccggcggcaactgcgagctgacccgcgccggcgacgcctggcagaccgacaacggcgtgcacctggtgggtctggccaatctgcccgcgctgctggcggccgacgcctccagcctgtacgcgcgcaacctcctcgccttcctctgcctgctgttgggcgccgaggggctgcggatcgacctggccgacgacctcatcgccgccaccttgctcacccaccagggcgaacagcgcttcggcgccgcgccgaccccggccgctccggcgccggcacgacaggagccgcatcatcatggttgatcccttcatcaccagcttcaccatcttcgcgctggcggttttcgtcggctaccacgtggtgtggaacgtcactccggcgctgcacacgccgctgatggcggtgaccaacgccatctccggcatcatcgtcgtcggcgccatgctgcaggtggtggacgtgggcggccagcagatcaccgtcacctcggtgctgggcgccgtcgccatcttcctcgccagcatcaacatcttcggcggcttcctggtgacccagcgcatgctggacatgttcaagaaaaagaacaggggataatccgatgcagaacatttccgcggttctttacctggtttccgccgtgctgttcatcctggcgctgaaagggctgtccagcccggcctcggcgcggcgcggcaatctgtacggcatcgtcggcatggccgtcgccgtgctgaccacgctgctgatcatcgacaagccggtgctggcgttgatcgccggcgccatcgccgccggcgcggccatcggcgcctggaaggcgcgcacggtggaaatgaccggcatgccggaactggtggcggcgatgcactcgctggtgggtctgtcggcggtgctgatcgcggtggccgccattttccacggcggcgtcgagcacacgccggtgcagaaggtggagctgttcatcggcgccttcatcggcgcgatcaccttcaccgcctcggtgatcgcctacggcaagctgtccggccgcttcggcgccaaggccatacacttcgctggccagcatccgctcaatctgttgctggcgctggcgatggtcggcttcggcctcgcctacttcgccaccgacagccaggcggccttcctcgccatggtggcggtggcgctggcgctgggcgtgacgctgatcatcccgatcggcggcgccgacatgccggtggtggtgtcgatgctgaacagctattccggctgggcggcggccggcatcggcttcacgctggacaatccggtgctgatcatcgccggcgcctgcgtcggctcgtccggcgccatcctgtcctacatcatgtgcaaggcgatgaaccgctccatcgtcagcgtgctgttgggcggtttcggcagcgaggccgccgccgggccggcggcgggcgacgcggcggccaaggcctacaaggccggcagcgccgaggacgccgccttcctgatgggcaacgccgaccaggtggtgatcgtgcccggctacggcctggcggtgtcgcgcgcgcagcacgcgctgcaggagttcgccgaattgctgcacgagcagggcgtcaatgtccgctacgcgatccacccggtggcgggccggatgccggggcatatgaacgtgctgctggccgaggccgaggtgccgtacgagcaggtgctggagatggaggagatcaacgccgacttctccaccaccgatgtggtgctggtgataggcgccaatgatgtggtcaacccggcggcgcaaaaggacaagcaaagcccgatctacggcatgcccatcctggaggcgcacaaggcgcgcaacgtgatcgtggtcaagcgctcgatgagcgcgggatatgccggactggacaacgagctgttttacatggataaaaccatgatggtgttcggcgatgccaaaaaagtggtggaggatctgctgaaaaacgcagcgcactgacccgccgccgctgtcgaatcgcccgccgccggcgggcggttcgccatccgccgcctgccccgtcccgaccagacaaaggaacgcgcatgcccatcctcagctccattctgatcagcggcagcatgatgctgccgacccaggccgaaccgaagctgcagaacaccgaatggctgctggaggcgccggcgcaggcagcgccgctgccgacgctgagcatcgccgacagccgcatcagcggcttcgccggctgcaaccgcttcacgctgggcatagacgacgacggcaaacatcaggtggcggccacgcgcaaactgtgcgcgccggaggtgatgcgccgcgaacaggcgctgctgaaattgctgtcggcgccgttccgcctgctgccggccgaggacggcaagcacctgaccctgctggcgggcaagaccggctaccgcttcgtccgccagaccgccgccgtcgcggcggagccgccggtgccggccgtcgccgcgctgcggccggtggccggcgagcagtactggtatgtcgccagccagccctgcggcgcgggcgccgccgcctgtctgcgggtgcgcagcagcgaggaccagccctggcgcagctacgccggctccatcgccggcttcgtgccggaggccggcagccgctattacctgaagctgcaaggcgtgccgtccgttgacggccagccggcgctgcaattgctgaaagtggtataccgcgaaaccgtgacgccgctggccgactgaacggaaccaccgcggccgcggcgcgtcatagcttatttatcaggaaatcatgatgctgcaacgcttgtccctattggccctgagcgcgaccctgctgagcgcttgcgccgcgccgagcgcgcccgccgtttccgccgcgcccccttccctggccgagctgcagggcgaatggaagcagaccaatggcggcgagcaggccatcttgctgcgcatcgaccagcagcggctgttcgccaaggccggctgcaacggcatgttcggtccggccgcgctggaagacggcaagctgcgcgccgaacggctggcctcgacgctgatgatgtgcccgcccgaggcgatgcagcgcgacgccaagctgtcgcgccagctggaggccggcatgacggccagcctggacggcggacggctgaagttgtccgacggcaaggacgcgttgatcttcgaacgccagccgcagggcgagatcaagttcatctatgtcgcgccgcagcgcaaggcctgcgtcggcgtcgcgcctatgcaatgcctgcaggtgcgcgacgacaagtccaagccgtgggagctgcattacggcgagatcgaaggcttccagcccgagcccggcgtcgcctaccggctgcggatcaaggaagtgaaggtggacaatccgccggccgacgctccttccatccgctggattctggatctggtggtcgagcaggaagtggtgaagaagccctgagaggtggttcgcgatctttcgtatcgaacttgcgagagacgacgcgcaacatgtatgcgatgcgcccggaatcccttcaagcctgccgctgggtggcaggcccgaggttttaagcggctgcttgtttgagccccgcgacgttagcgcggggcgagttcagccgcgcctcgggcctgacccgacccggcgggtagccgaaggccaggcttgcagggtggcctttaggggtggaggggatatttggccaagcaaatatcccctctctgctcgccgggcagccccggctatgaaaatcattatccgcgcagcggattcaagacgatgaagattgcgggcagactccggctcgggcgcgggatgagcgctctgctacaatcgcggcattgaaattgcaggaggccgccatgagcctgattcccgaaatcaaaccgcagcagtcgctggaattgctcaaagagctgcacatcctcacccgcgacggcaagatcaaccaggacacccgccgcaagctgaagcaggtttaccacctgtaccagttcatcgaaccgttgatggccgacgtgctggccagcaagggcgcgatgacgctggccgaccacggcgccggcaagtcctacctcggcttcatcctgtacgacctgttcctgaaggacaagccgggcgcccatgtctacggcgtggaaacccgccaggagctggtggacaagtcggatgaattggccaggcggctgggcttcgccggcatgagcttcctcaacctcagcgtcgagcagtcgatcacctccgccgcgttgccggcgcaggtggacatcatcaccgcgttgcatgcctgcaacaccgccaccgacgacgccatccgcttcgcgctggccaaggacgccaagtacatcgtgctggtgccctgctgccaggccgaggtggcggcgacgctgcggcagaagaagaacgagaccttcggcaagacgccgctgtccgagctgtggcgccacccgatccatacccgcgaattcggcagccagctgaccaatgttctgcgctgcctgcagctggaggcgcgcggctaccagttgacggtgaccgagctggtcggctgggagcactcgatgaagaacgagctgatcatcgccaagaagaccggcaagggcaagagcagcgcccgcgagcgccaactggccatcctggacgaattgaacctgatggacctgcgcgagcgcttcgcctactgatgacggcgcaatgcggcggggcgttcgtcccgccgttcggttttcttcctagcgcgccgccgccgggacgaacttgaactcctggatcaccacttccacctccttgccgtccgccggcggcttgccctggaacagccacagattgatgtgcaccggcagcggttgctgcggcacgcgccgggcggcgtcggtcggggcgaagcgccagctggcgatcgggtactggtcgctgtcctggaagccgtgcagcgactggtaatagacctggccggcgttccagtcgaagcggtgggtgctgtagccgccgttgagggcgaaatcgaagctgtacgaggtcgactgcaggccggcctgggccggatagacggtgtagttgcccatcgggttgcttgagctgccccagcgcgagaattcgatgtcgatctcgttgctgccatcggggccgacatcgggcgtcgggtagttgaacaggcccagcacgatgttggggtcgaactggtcgggccggccgatcagcttgaactggtagcggccgaagcccagccgctgcggcaggtagagttcggcggcggtccattggccgccgcgcttggcgattttcaggtgcagccggccctgggcgtctagccaggcgttgtcgtcgtcccagacattggggccggggccgctgctgccctgattgcgcacttcccagtcgtaaccggaaaaacgcagggtcttggcggcggcggcgccgcacagcgccaggccggccagcaggactgcggcgttacgcagcgtagttttcatggtggggctccgtgagatggagccgccagtgtgccacggcggcatgacggccgggcgaccgccgcgccgcaaggacaggcccgctacagccggaagcgcgcggtcacgttctgcagattgtgcgacagcgcgttcagctcgctggaggtggtggccagctcctccacggtggcgctgttggcctcggccatctgcgatacctgctccatgctctgcgccaggctgaggctggcggtgcgctgctcgcccagcgcgctggtgatgttgcctatggtgccgacgatggaatgggtgctgccggcgatctcctccatcgagtcgctggcctcgcgcgcgctgccggagaccgcgtcgacgctggccaggctctgctccatgctgcccaccactttctccacgccctgctggatggcggtgatcatctgggtgatttcctgcgccgagctggcggtgcgttcggccagttttctcacctcgtccgccactaccgcgaagccgcggcccatctcgccggcgcgggcggcctcgatggcggcgttcagcgccaatagattggtctggtcggccacgtcgcggatcacggtgacgatattgccgatgcgctgcacctcgccggtcagcgtgcgcatttcctctgaggtggcggccaccgcgctgctgaccgactggatcttgcccaccgaggcctgcaccgcgtggccgccgcgcccggccaggtcgccggcctcccgcgcctggcgcgaggcctggtctgagttgtcggcgacatggttgatgctgacggtcagctgttcgatggtggccgccgcctcggcggtggcctcggactggcgctgggcgccgccggccacctgctgcgccatgctggccagctcatgggccgagtcggacacctggttggcgttgtcctggatgctggacaccacttcgcgcaggccctggcgcatgtgctggatgatgcgggcgatttccaccgcctcgtcgcgggaatcgggcagcgactcgtcggcgccggacaggtcgccctgctggatgttgcgcaccagttgcgccgatttgcgcagcggggtggtcaccagattggcgacgaacagcgccaccgtcaccgcgatggccagcgcgatggcggcggagatcagcatgatggtgacggcctggttataggcggccttgctgtcgtccagcgcctgctgcaccttgtcgttctggtaggcggtcagctcgtccagcgtctgggcgaaggccgcgttggccggcacgaagcgctgcttcaaaaaggcgaccgactccgcgtccttgttggcgcggatcagcgcatacagcggcgcgtacagcgcggacagcgcgccgcgggcctgctgcacccgggtgaagacttcgcggcccttggcggacaccagggtcttgtccagttgttccaggctggcggtgttctgcgcgcgcaactcctccgccttgctgatattggcttcgatttcctgcgggctctgggcgatgatggcgtcgcgcaccgcgcgcgccacgcccatggtggccagcacgatcttgttgcacagcgccgccttcggatagcggttttcggtgatttccacttccttggcctggatggcgttcagcttgaggatggctgtcagcacgatggctgccaggatcagaatcatcaggccgtagccggccagcagcttctgcttgacggagagttggtgcagcatcggtttctcctatgaggcggccaggccgcgcggcgatggggccgagccgcggcgcgccccatatgctgaaaaatagttgccgcgcggcaaatagggaaactcattcttgccatcgccggcggccgcgcgacggtaccgatggccagccggcggcgtttccccttccattcgccatggtattgcctaagctcaaaccacctatacccggacgggagagcgagtgatgcaagtggccgagatcttcgagaaggcgtcgggcaagctgcctatggtgcccaaggtggtgcaggagctggtggccagtttccatcgcaatgacgtcaagatcgacgaaatcaccgacaaggtcggccacgatcaggtgctgacggcgcgggttttgcggctggccaacagcgcgcgcttcggcagcagccgcaaggtgggttcgctggacgacgcggtggtgctgctgggcttcgacaacctcagggtgctggtgatcgcctccggcgtcaccggcgccacgctgggcatccacggcttcgacatgaaggcgttctggacgcgctgcttcgcgatggccaacaccgccaagctgctggccaagctggcgggcctggacgcgcagcttggctatacctgcggcctgttggccaatatcggcgaactggtgctgtacgtggcggtgccggagcaggcgcagcagatagacaagatcgtcgccggcggcgccgagcgcatcagcaccgaacgcatgctgctgggcatggatctgaccgagctgggcgcggagctggcgcggcgctggaatttcccggacgcgatccaggaggcgatctacaaccagcacgacctgctgaacgaagacgcgtcgccgtacgcgctgctgatcgggctgtccaccttcctggtggcgggcttccgcaatgagatgggcgtggccgacatgctggtcagcctgccggagcgggtgctggagcggctggggctgggccgggagcgggtggaggcggcgatggagccgctgcagcaggcctgcacccaggtcgacgacatgttctgatccggcctgcccgggcgcgcttcaggcgccctggccgccgcgcagttcgcgccgcaagatcttgccgacgttggacttgggcagctcgtcgcggaattcgacatggcgcggcaccttgtagccggtaagggcgtcgcggcaatggcgcagccgctcgtccaccgtcagcgccgggtcctggcgcaccaccacgatcttcaccgcctcgccgctgcgcgtgtcgggcacgccgacgcaggctacctcgcgcacgcccggatgccgcgccaccacgtcctccaccacgtcctccacttcgttggggtaaacattgaagcccgataccagcaccatgtccttcttgcggcgtcggcggtgcgcacgccgatgtcgccggtggcgaagaagccgtcgggatggaaggccttggcgctgtcttccggccgctgccagtagccggccatgatctgcgggccgcgcacgcagacttcgccggcctcgccgtcggccatcggccggccggcgtcgtccagcaggcattggccgcccagccggttgaccaacaggcaattgatggccagcgcgaacacgtggtacagcggcagcggcagcggcgtggctaccacggcgcggctttagcggcgtgccggcgcgggcctctgccaccacctgggcgaagttttccagcgccatgatggagctggactgcgcggcggcgggcctgcggcgcttccagcgcgcgatggacgcaggccacggcgacaaggacatggcggcgtccttcctggtttgagcgcgaaaaagccgccgggcccggcggcgcggcggcttggagtcagataggggacgggctcagctttcttcgtcctcgccggcctcttcgacgtggtcgaggcggccggtgtagcgcagctccacttcctgggtcagcaggtccaccttcaccaccgacagctgcacgcggtcgccgcgggccagttccggcaggcccgggatgcgcaggcgcagcggcaggccgtcgatgcgcaccaggtcttccttgatcacggaagcggtcggctcggtgatgttttcctgcagcagatacttcaggcaccagtagtgttccatcttgtcctggaacgacaggtaggcgccgtaggtggcgtcgaagtcgcgcagaatggcgaacagcatcgcgtcgccctgggcgaacaagggcttttcgccgcgtatcatcgccgagagctggcgctggttgatgaagtcgctggcgcggcgcagcggcgaggtgctccacgcgtactgggccacgcccaggcccatgtgcggctcggggcgggtggtcatccgcaccttgcccatgctttgcgcgcggtacatcgccgggatgtcggcttcggccagcatgcggccccattcgctgttggccaggatcatcagttcggagaccagcttgtccatcggcgcgccgcgcttgcggatggtgatggacactttgccgtcgaccacgtcgatgttgtagtcgtgctgcactgggcgggtcgggtcgtatttgccgcggcgcttttccagcgcttcggcgaactgccacagccacaccagttcgcgtttgaacggatagtctacgcccggatcgttggccagcgtctgctcattgaacacctgttccagttcggcgtggcgcaggttggcggcgatcggcaccagctcgatgcggttctcgaacgccaccggctcgaactccggcgtcacctcggcgtacagcgagaacgccgggcaggcgcggccttcctgcaaggtgaaggcctgcaccacgtcgtccggcagcatggtgatcttgtcgccggggaaataggcggtggacaggcgcgacagcaccatcttttcgatgtcggaatccaccggcacgcccagcgtcggcgcggcgatgtggatgccgacgcgcttgttgccgttgggcagctcctcgaccgacaaggcgtcgtcgatttcggtggtgttggcgtcgtcgatggagaaggcctgggccgaggccagcggcagctccggcagcgcggccggcggcgcgtacttgccgaagccgacgcccttggggaagtactccatctggaagccggccatcaggtaatcaggcaccgagggaatgccgcctaccttgtcggccaggcgcagcggcggcaggccggtttcgcggctggcctggtcgaaggccttgtattccagcgtgttcttgtcggggcgccacagcagagtcatcagctgcgagcggatggcttccggcagggcgccggttttcagctcgcggacccagccgtcgatctgctcctgttcgcgcttcttgcgctcgacgccggccagcgcggcttgcagcgcgtcctgcggcgccttcttgtagcggcctttgccttttttgtagaagtacatcggcgcgccgtgcagccggcagatcagcgcggcggcctcgacggccgacggcgcgtggccgaaatagtcggcggccaggtcctggtaggagaactcgtcgtcctggctgcattcccacaggaagtccaggtcgatgtccgcagccagcgcgtccacggcgggcagaaaatccgccagcggggagctaaactccagaaacacattggcgctcttgagcttggcgcgcttgccgtgctgggtatccacctgcaggctggcgtcgctgcgcgagactatgctgccaaccttgaaactgccgctctcttcgtaaaaaacgttcatcaaaacatgccaggccgttgaatttaagggcggattatagcagttcgcccgcggctcaggcgccataaacttgcacgcgatgcgggcggaaccgcatcgcgacgggaaggcgatgtcatgaaaccggctgcgcccctctcccccggccaacgcacccagctggcgcgggaaatcgaccgcatcggctacatgctggtgtcgcgctgggagcgtccgctggccgcccacctgctgtcgctggccatgcggctggaggcgctggcgggttcggtggggcgggtcgacatcgccgccgaggcgcgcgagctggccgacctgctgcggcagtggttgcagcagcaggcggaaccgtccgagcaggaacgctatgggctgctgcgccatcatctgggagtggtcagccagctgggtttgatggagcggcaagcgggttcgagcagccaggacgcggcggagcgcagcggcaaccccctgctttacctatggctgcccggcggcatcgacgccgcgccgctgcaaaggcagctggcctgtttcggctacgaagcgctggcgctggcgcaggccgccaagctggccaaggcgctgcaggaggaaacgccggcggcggtggtggcgttcgccgacttcgccgacggcgaccccatcctgcagttggcgccggcgatcagcggcagctgtccgctggtgctcacctcgccgcggcgggattttccggcccggctggaagcggtgcggataggggccagcggctttctcgattggccgctgcaggtcaaccaattggtggacctgctcagcttcggcgacatcggcgagcggcgcgacccgctcagggtgctgatcgtcgaggacatggcgtcgctggcggggctgtattcgcgcgcgctggccgcccacggcgtggaggcggtcagcgagaccgacccggagcgggtgccggagctgatcgagcggctgaatccggacctgatcctgctggacatgtacatgccgcaatgcaacggcatcgagctggccaaggtgatccgccagcagcggctgctggacgggattcccatcgtgttcctgtcggtggagaagcgccaggcggtgcagctggacgcgctgatgctgggaatcgacggctttctgaccaagccggtggcgccggaagagctggtggtgacggtggtgaaccgcgcgcggcgctaccgcaaactgcgctcctacatcgccaatgacagcctgaccggcctgctcaaccattcccatctgcacggccagctggacagcgccgtcgagcgcgcccgccgcgccgggcagccgctgtcgctggcgatgctggatctcgactatttcaagcaggtcaacgacaactacggccaccaggtcggcgacgaggtgctgctcaatctggcgcgcttcctgaaggagaggctgcggcgcaccgatctggtgggccgctacggcggcgaggaattcgccatcgtgctgaccggcacgccggcggacaaggcgtgcaagatgctggagacgctgcggcaggatttctgccggctggagcagcaggtgggggagaggaccttccgccagactttcagcgccggcgtcagctcgctggccagcgccgaagacgccaccagcctggtgcagcaggccgacgagatgttgtacctggccaaggaaaacggccgcaaccgggtggagagccgcggcggctgaggcgcgcaaaacaaaagcccccgcagtggcgggggcatgcaagcggcggagcggctccgccagcccgcccgcgcgaggcgggcgaggccgtccatcaattacttgatgttgtatttgatcgagtagatcacggcgttctggtacgcggtgctgcccagcttctggtcggcgtagcggtactggatgccggtggtgaccgccttggtcggggtccaccacagcgcgatggcaccgttctggcctacgcgcggacggtcgccgctcttgtacacgctgataaacttgtcctggcggttgaactcggtttcatgccattgggtgatcatcaggttctggccgaaagcttggaacgggtacagcatcacgtagccggtcatgaagccgttgtagccggatgcggaaccaacttggtgagcatccatctcgttgtgcacgccgaagaacggcttgatgctcagcgcgccgaagctcagatcggtgcccaagcccagtacgcggttctgagtgaagaactcgttgccgcgggtgtcgtagatgtgggcgtacagttgcaccggcacgccgccgatgtcggtcaggttgtagcggccgattaccttggtggtgtagcggcggtctttggtgccggtgccgttattgcccttgcccgggttttccaggtcgaagaagccatagacttcgccccacttggcgcccaggccgccttcggcttccaggtaaccgaagtcgcgcttgccgctttgttcggtggtgcggttcgaccaatccagccagttggcgctaacgtttgcgaaggagtattcaccgccggcgtgagccagggcggaagcggccaacagagacagggccagcagcgacttgcgagttttcattgtttcaccagactattttcatgtagtaaccgtccgacaagctgtcggcgagcgcgcgcagattagacgtagaaatggccttgtgcaaacaatttgtcacgcttctgtcgcttttctgcaaagaatgtttgctttgttgtagcaagatgacaaataagttacattttgttgctgaaatgccacatggaaatatctctacgtgaagataagtatctgagcacgcaccggtttctggtttgtttcaagtcaaaccatctggtcgggccagccgaaaatccgcaggcataccttgccgctggcattgaattccaccccttcctcttccaatagcagccgctgccagtcggcatgctggctaccggggcgcgacagcctgccgccggcgcccagcacccggtgccaaggcgcggtcaccccctccggcaggttgccgagcaggcggccgacatggcgcgagtggcgcggatagccggcttgctcggccagcgcgccgtaggtggtgacgcggcccggcggcacgtcggccagcagcgccagcacgcggcgggcgaattcgggcggcatcagcggtagcgcgggtcggcggcgtaggggttgctgcgcttctccacgcctatggtggtgaacgggccgtggccggggatgacggtggtgtcgtccggcaggatgaacagcttttgctggatcgcgtctatcagctgctggtggttgcccattgggaagtcggtgcggccgatcgagccctggaacagcacgtcgccggccaccagcaggctggccgccgggctgtagaacaccacgtggccgggagtgtggccgggacagtggatgacttgcagcgtctcttcgcccaccgtcaccgtatcgccttcttccagccagcggtccggcgttagcggctcgctgcgcggaaagccgaacatgccgccctgggtgggcagctggtccagccagaagctttccgcgcgttgcgggccttcgatttccacgcccagctcttccgccagcttggccgcgccgccggcgtggtcgatgtggccgtgggtcagcagcagcttttccaccgtcagcccctggctgtcgatccaggcgcggatgcgcccgatgtcgccgccggcgtcgacgacggccgctttgcggctggcgctgcaccacagcacgctgcagttctgcgcgaacggggtgaccgggatgacgtgatgcttcaaggccatggctatgctcgcggaaaaacggaatctgccattctggcatggcctgccgggtttggggaggggtggccgcgcccgccgggcgggcgtttcgccactggccgcgccggcgcggcggatcgcccggcgatgccgggcatccgacctacgcgtacagcgctcgctcgatgaactggcgcggcacttttggcttgggcacccgcacgtcgaaccagccgcgcacgtcgccatccaggccgatgccgtgcatgaagttgtacaaagccttgttcaggccgcggcccatcagctcgtggtcggtgccggtggggtcgatgaagccgacgtcgttcttggcgaagtcgcctttcggcagcggcaccagcttgacgccgtattcttccggattctggcccaccggcgagtgcacggtgcaggcgaagcggtggaagaagcccgactggatgcagccgttgtcgaacagctggcgcacgtattccagcgcgtccaccgtgtcctgctcggtctgggtggggaagccgtacatcaggtaggcgtgcaccaggatgcctgcctcggcgaagccatgagtgacccgtgccacttgctccaccgacacgccctttttcatcagcttgagcaagcggtcggacgcgacttccaggccgccggaaatggcgatgcagccggattccgccaatagctgcgccagctccggggtgaacgatttctcgaagcggatattgccccaccaggagatggacagcttgcgccgcagcagctcctcggccagcgccttcagcatcttgggcggcgcggcctcgtcgacgaagtggaagccggtctggccggtttcggcgatgatggcctcgatgcggtccaccagcagctcggccgacgccgtctcatagcgcgagatgtagtccagcgtcacgtcgcagaagctgcatttcttccagtagcagccgtgggcgatggtcagcttgttccagcggccgtcgctccacagccggtgcatcgggttcagcatgtccagcagcgacaggtagcggtctatcggcaggccgtcccaggtgggggtgccgacctcggagaacggcacgtcggcttcctgcatgttcacatagcgcaccgcgccgtcctggcgcaggaaggtgcgcaccaggcggctgacgccgcgtttgccctcgatgtgttccatcagcgccagcagcggccgctcgccgtcgtccagcgtcacatagtcgaagtagtcgaacacgcgcggctcggccagctcgcgcagctcggtgttggggtagccgccgccgaggcaggttttgacttccggccagtggcgcttgatggtctgggcgatgcgaaaggccgcgtacaccgcgccggggaagggcaccgagatcagcaccagctgcggccggtgcgtcgccatcgcttcgcgggtcagcgcgtccagcgtgtcgtccacccagttgggcgccgccgccagcgccttggccagcggctcgaaggtcggctgcgacagcgccagcgattcggcgtagcggacaaactcgaagcgcgggtccaccgcctcgcgcagcacgtcggcgatatcgttcaggtacagcgtggccaggtggcgggcgcggtcctggctgcccagcgcgccgaaggcccaggccagcggatcgccgccgtccggatcgtccgggtccatatacacgtccagcgcggcgaagcgcgggccttccggcaggtagttgcggccggcgatgcggtaggacagcgtggcgtcgcggccctgcaaaaagccgatcaccgcgtctatcgtcgccgcgtagcgttcgtacgagatgtcgaactgcatcatgcagtcggtgcgctggcgcatggggatgcgttgcacatgctcgcgcagcgtctgcatgccggcgcgcgagaacagttgcagcaccagcgccagcgccaggtcttcctgcgaggccgtgacgccgcgcgaacgcaaaaagccggtcagataggcggtggacgggtagggcgtgttcagctgcgtcatcggcgggatgagcgacagcacgcgcagggagctggcagacatgcgaaaaatccggcgggtggttcaaaaagcatagccgggctcaggcccggctgcgtgcgattgtcccacagcaaacgatgcgagactaggcggtcttggcgctgaactgctcaaaggcctccagggcgttggcggaatacatcaaagaagggccgccgcccatgtagacggccatcgccagcgcctcttccacttccgtcttgctggcgcccagcttgaccaaggcctgcgcgtgaaagcccaggcagccgtcgcagcgcgcggccacgcccagtgccagcgcgatcagctccttggttttcctgtccagcgcgccgtcgcggctggcggcgcggcccaggtcgttgaaggcttgcatcacgtccggcacgtcggcgcgcaaggtggccaggtgttgggagatggcgtgggtcagttcggggtagtggatttcgctgctcatgatcgtcgctccatctgcgggttaagatatattgatttatataatatcaattgatatattgtagtcaagtgtctaatccgaaagaaagttttccatgccgtctcccaccatcgccatgatgcgcgccgccgccggccaggcttgcggcctgctgcgcgccttgtccaacgaagaccggctgctgttgttgtgccagctcagccagggcgagcaatcggtcggcgagctggagcaggcggtgggcatccgccagcccacgctgtcgcagcagctgggcgtgctgcgcaacgagggcctggtcgccacccgccgcgacggcaagcgcattttctacgcggtggccgacccgaacgcgctgagcgtgctggccaccctctatcagttgtactgtcccaaggagtagccatgcagctggactggagtcatttcacgccctggagcgcgctggccggcggcatgctgatcggcttggccgccgcctggctgatcctgctgaacggccgggtggccgggatcagcggcattgtcggccagctgctctcgcccggcggcgacaagggctggcggctggctttcgtcgccggcctggttctgtcgccctgggcataccggctgtgcgccgcgccgccagccatcgctctggatcaccggccctggctgttgatcgccgccggcctgctggtggggttcggcagccggctcggctccggttgcaccagcggccatggcgtgtgcgggctggcgcggctgtcgccgcgttcgctggcggccacgctggccttcatggccgcggggttcgccgtcgtctggctgatgcgtgatggaggcgtgctatgaaatcgctcgcaagcgcaggctgcgccggcctgttgttcggcctgggactgctgctggccggcatggccaatccggctaaggtgctggcctttctggatatcgccggccgctgggatccgtcgctggcgctggtgatggccggcgccatcgcgacagcgctgccggccttcgcgctggcgcggcgccgcgagcgcgcgctgctgggcgggccgatgcagctgcccgccgttcggcggatcgaccggccattgatcctgggcagcctgattttcggcgccggctgggggctggccggcatttgcccggggccggcgctggtattggccggcagcggcgccggcgccggggtgctattcgccgcggcgatgctggcgggcatggcgctgcatggccgctgggcgcggcgccggagctagcggcgggaaatccgcgcgctcggcgcgtataatccagacgtcatcgacaatggagcgcgcagagtgaaaaccgcgggatggatggtgctgggatggatgtgggcggcggccgcgctggcggcgccgcggccggcggagctgtgcggcagctgccacggcgccgacggcaacggcgcttcgccgcagtttccgcggctggccggccagcaggcggtctatatggagcagcagctgctgctgttccgcgacggcaagcgcgacgacaaggcggcgcaccgcgcggcgctggccaagctggatgatgccggcatccggagcgcggccgcgtatttcgccgcgcgcgcgccggcggccaacgcggcggccggggccgatcccaagctcgtcgccgccggcgccaagctgttccgcgagggcaatctggcggtgggcacgccgccctgtttctcctgccacggcgaccgcggcgagggcaacgcgacggcgccgcggctggccggccagcatgccgcctatctgcaaagccagctgcgggtattcgacgtgtcgcagcggccggcggcggcggagatgcaggaaatcgtcaaaaccatgagcgaggacgacatcaaggccgtgctcgcctaccttccgggcatgtagccgacaaaagaaaaggccgcggaaggcggcctcaaggttcggagaaaaacgaccgccgggcggccggttttccgtcggtgattctagcgccgtctggcgcgcgcggcaacgccgctcagtcgcccagcgccgccagcagctcggcctgctgttcggccaccagcgcgtcggtcaattctgcgatgtcgccgtccatcatctggtccagcttgtacagcgtcaggttgatgcggtggtcggtgaggcggccttgcgggtagttgtaggtgcggatgcgctcggagcggtcgccggagccgatcaggctcttgcgctcggccgcttccttctgattcttttcccgcagctggatgtcgtagatgcgcgccgccagcacctgcatcgcgctggctttgttggcgtgctgcgagcggccgtcctgacactccgccacgatccccgtcggcaagtgggtgatgcgcaccgccgagtcggtcttgttgatgtgctggccgccggcgccgctggccctgaacgtgtcgatgcgcagatcggccgggttcagcaccacttcggcgatctcgtcggcttcggccatcaccgccaccgtgcaggcggaggtgtggatgcggccctgggtttcggtggccggcacgcgttgcacgcggtggccgccggactcgaacttcagccgcgagtacgcgccctggcccaccagccgcacgatcacttccttgtagccgccgaggtcggactcgctggcggagacgatctccgcctgccagcggttgcgctcggcgtagcgggtgtacatgcgcagcaggtcggcggcgaacagcgccgcctcgtcgccgccggtgccggcgcggatttccaggaagatgttcttgtcgtcgttggggtccttcggcagcagcagtttctgcagctccacctccagcgccgccagcttgtccttgccctcgaggatttccgcctgggcgaattccttcatttccggatcggccagcatctcttcggcggcggcgatgtcgccttcgcactggcggtaggcggcgaaagcctccaccaccggcgtcagctcggcgtgctcgcgggtgagctttttgaaggcctccatgttctgggtggccgtttcgctggccagcaggtgggtcacctcttccaggcggtcggccagttgcgccagcctggttgcgatagacgctttcattacgactccggatgtaaacggtaaagccgcgcgatggcttgcacctgcgcgtcgtgctccgcgccgctgcccgaggacagggcctgggtgggcgggtgcatgagtttatttgtcagttggacggacaaggcctccaacactttgtccggcgcgtcgccgcgcgccagttgcttcatcgccgcttccagcgcgtggcggcgggtgcggtcggcctcgtcgcgcagcgcgcggatcagcggcacggtctcgcgcttcttcagccagtcggaaaactccgccacccgcgcctggatgatggtttcggcttcggccgccgcctgctgccgcgcttccttgcccacttcgacgatgccggcgatgtcgtcgacgctgtacaggaacacgtcgtccagctgggcgacttccagctcgatgtcgcgcggcacggcgaggtccagcatgaacatcggccggtggcgccgcgccttgatcgcccgctccaccatgcccttgcctatcatcggcagctggctggcggtggatgtcaccaccacatcgtagcgcgccagcgcctctgggagctccgacagcgtgatggcgttgccgccgaactgttccgccagccgctggccgcgctccagcgtgcggttggccacggtgatacaggacgggttgcgggcggcgaaatgggtggccaccagctctatcatctcgccggcgccgacgaacagcacgttcagctcggcgatggacgggaagatctgctcggccagcttcaccgccgccgccgacatcgacaccgagcttgcgcccaccgcggtgctgctgcgcacttccttggccaccgcgaaggtgcgctggaacaggccgttgagcatggtgcccagcgtgccggcgtgctcggcgctgcgcactgcgtccttcagctggcccaggatctgggtttcgcccagcaccatcgaatccagtcccgaggccacgcggaaggcgtgccgcgccgcgccggaggcttccatccggtacagatagggctccacctcggccaggctcaggccgtggaactggcacagccaggacagcgcggcgtgcgggtccggactgcagcagtagatctcggtgcggttgcaggtggagacgatggccgcctcgcgcgcggcctgcgaggccaccagactgtccagcgcgcgcggcagggtttcagccggaaacgccagcttttcccgtatcgacagcggagccgtgtggtggttgagtccgaaggcaagcagatgcatgggcggaaagtgccgcagacgaaaacaggacattttagcctaagtgggcggcggcgtcccgccgagcttgcccggacggcatggcggcggcgggcgcgcaggcggtatagcgccgacgcggcgcgcggcatgttgttttgttgagacacggacaatgggcgagttgccgctgtcattcataaaaaaacacaattttaatcaaagttttaacaattctctggttttggcctggcgatgccaggggctggcataaggtgctgaagtatttgccatgcccgatgattaatgccattttcatcgcttgcgtgcatgtttcaggcatgtgacagaggcaaggcagatttgcgccaaagcagcgcaaacgccgtgatgaacaaagggaaaatgatgagaatcaagattctggcccaggcgatcgccgccttcggccttatggggggcggctttgcccatgccgcggacggtagcgacagccagctggagcgggtgaccatcaccggctccaacatcaagcgcatcagcaaggaaggcgcgctgccggttgaagtcctgaaacgggaagacatcgaaaaaaccggcgcttccaccacggtgcagctgctggacaacctgacttcttccggcagcgtgctgtcgggcaccaattcggccagcttcgccgccggcgcggccaccgccggcctgcgcggcatgagctccaagtatgtgctggtgctgatcaatggccgccgcctgccgaactacgcgatgttcatcagcggcaccgactctttcgtcgacctgaacacgattccgctggcgatgatcgactcggtcgaaatcctgcgcgacggcgcttcggcgatctacggctccgatgcggtggccggggtgatcaacttcaagaccaagcgcaatttccaaggggtgaaagccaccacccgctacggccagaccgaagacggcgacggcatggagcagggcgccggcctgatgggcggcatcggcgatctgagcaaggacggccagaacttcatgtggtcgttcgacgcttaccatcgcgagccggtgttcgccagcaagcatgagccgaccaagacgctggattaccgccgcttcggcggcaaggattcgcgcagcggcactttgtggggctcttggaaagactattccaacggcaagttctataaccctctgcccggctgccccaagtcgctggtgacgctgtccaacggcaacaccatctgccccagcgacaacgacgaactgggcacccagctgtcgccgcggacttcgcgctacggcctgaacggcaactacaccaagcggatcggctcggacagcgagctgttcgtcgaagccagcgtcaaccgcagccagacctccctcgacggcggctacgcctggatgagccaggtgcagatcaagaacggcaacgcggcctatcccaccaatccggccacgctggcggcgatgcaggcgctctatccgcagttcacccccggcgacacgctgcaagtgacgcgcagcctgtatgagctgggcaagagcatggtggatgtgacggccgacacctaccgcgtggtcgcaggcggcaccaccaccatcggcgattgggattttgaaggctcggtgaaccttggcgaatccaaggtgaccatgcagaccagcaatgccatcctgaacgcgccgttcatgaacatgctgcaaaacggcgcgcccgccggccagcccatgttcgatccgttcgcgcagaacaaccaggcgggcagcctgacgccatacgccaccaacctgaccaacagcgccaattccaagttgcagatgctggagttgaagaccagcaagagcgagcttgcccagctgccgggcggcccgttgggcttcgccgcaggggtgcaatggtggcatgagtcgatcgaaagctcgcccgacgcgctgatccgcagcggttctatcatgaactacgcggcgcagcagggcctgcagtccagccgctcggtggcggcggcgtatgccgagctcagcctgccggtgatcaagaatctggaagcgcagctggcggtgcgcgccgaccactacaacgatttcggcgatacggtgaacccgaagttcgccttctcctatcgtccgtggcagcaggtgatgttccgcggttcggccacttcggcgttcaaggcgccgtccctgccccagttgtacgcgtcgcgccaagcctaccagtcgatttacgactacgcgcaatgcgcggacaagggcatctccacggccaattgcacgtcggtcaagcagcagatccgcagcggcggcaacccgaacctgaaggcggaaaccaacaagagctacggcctgggcgtggtgctgcagccgatgaaggagctttccgcgtcgatcgactggtacaagctggaccagaaggacaccatccaggcgctgccggcgcagtacgtggttgaccacccggaattgttccccggctacgtggtgcgcaagccgtcgggcatcgccggcatccgcggcgacatcgactacatcagcaccccgtacgcgaacgccggcaagacgatcacctccggcatcgacatcgacgtgcagtacgatctgtcgctggggggctacggcaagctgagtttccgcgagcagcaaacccgctacctgacgtatcaggacacggtgctgccgaccgattcgctgctggagaacgtcgattacggcggcatgccgcgctggaagaacctcttcaccgtcgactaccgctacgacaagtacagcgccgcgatcaccgcgcgttcctatgccggttacaagaacgcggcgtccccgcgcgacaccatcgcggccaacgtgccgcagcgcgtgccgtcgtacacggcgttcgacctcaacttcggcgtgcggccgctcaagacgctggaaatcaacggcggcatccgcaacgtcggcaaccgcgtgccgccgtacgccgccggggccagcctggtgacgttctccggcccgtccaccgatctgtggggccgcacctactacatcaccgccgactacaagttctgatagccagtcgccgcgcgcaggccatgccgctccctcgggagcggcattttcatttgcggctcagccttcccgccgcatgtccaggtgcagtatcccgccgtcgtcgtaaggctccgacaccggttcgaagtcgaaggcggcatacatcgcgctggcgtcctgctgcgccgacagcatgatggcgcggcccgggtagcgcgcctggcattgcgccaccgcctgcgccagcagcgccttgcccaggccctggccgcgcgcggcgggttccaccaccacccggccgatggcggcggcgtccgggtatttctcgccgggggcgatcagccgggcataggccagcagccggccggcctcgtcgcggcccgacaggtgcaggcagtgggtgtccacgccgtccacgtcgccgtacagcgattgctgctccagcacgaaaacccgatcccgcagctgcagaacctggtacagcgccagcggggtgaaaccgtcgaaaccgtggcaatgccacgctatcctgtttgccatagtagaattcctccatttcccgtaccggccgtcttcggcatcccggcaccgtgatgatgctataccacccggatcggccgcgtacccaaatccagatcaagacactagcattgataacatgaacagcaacgacctcttcgccccgccgggttccgccggcgacccgccgccgcctcccgccgcgccggaagccgccagcggcgactggattccgctggacctgtacgccgagcgcgcctacctcgagtacgcgatgagcgtggtgaaggggcgcgcgctgccggaagtggccgacggccagaagccggtgcagcgccgcatcctgtacgcgatgcgcgacatgggcctggcgcacggcgccaagccggtgaagtcggcgcgggtggtcggcgaaatcctcggcaaataccatccgcacggcgacagctcggcctacgaggcgctggtgcggatggcgcaggacttcacgctgcgctatccgctgatcgacggccagggcaacttcggcagccgcgacggcgacggcgcggcggcgatgcgttacaccgaggcccggctgacgcctatcgccgatctgctgctgtccgagatagacatgggcacggtggatttcgtgcccaactacgacggcgccttcgacgagccctcgctgctgccggcccggctgccgatggtgctgctcaacggcgcttccggcatcgcggtgggtctggcgacggaaatcccgccgcacaacctgaccgaggtggccggcgcctgcgtggcgctgctggacgacccgacgctggacaccgccggcctgatgcgatacgtgcccggcccggacttcccgggcggcggccagatcatcaccccggcggcggacatcctggccgcctatgaaaacggccgcggcagcgtgcgggtgcgcgccaagtgggagatagaccggctggcgcgcggccagtggcgcatcgtggtgaccgagctgccgcccggctcctcggcgcagaaggtgctggcggaaatcgaggaagccaccaaccccaaggtcaagtcaggcaagaaggcgctgacccaggatcaggccaatctgaagagcctgatgctgtcgctgctggaccgcgtccgcgacgaatccgacagcgaaagcccggtgcggctggtgttcgaacccaagtccagccgccaggacccggacgaattcatgaacatcctgttggcgcagaccagcctggaaggcaacgcttcgctgaacatggtgatgataggcctggacggccggccggcgcagaaaggcctgaagtccatcctgactgaatggatagacttccgccgctccaccgtcacccgccgcctggcgcaccgcttgtcgcaggtggacaagcgcatccacatcctggaagggcggatgatcgccttcatccacatcgacgaagtgatccgggtgatccgcgagtcggacgagccgaagcctgacctgatcaaggccttcggcctgaccgaggtccaggccgaggacatcctggaaatccgcctgcgccaattggcgcggctggaaggcttcaagctggagaaggagctgtccgagctgcgcgaggagcgcgagggcctgcgccacgtgctggacaccccggacgcgctcacccgcctgatccgcgacgagatccaggccgacgccgccaagtacggcgacaagcgccgcagcgagatcaaggccgccgaacgcgcggtgctgacgcaaaccaccgccgacgagccggtgacgctgattctgtcgcaaaaaggctggatccgcgcccgcgtcggccataacgtcgacctggaggcgctgagcttcaaggatggcgacgcgctggcggcggcggtggagacccgcaccgtgtggtcggccatcgtgctcgaccacaacggccgcgcctacaccatagacccggccacggtgccgaccggccgcggcgacggcgtgccggtggcgtcgctggtggacctgcaggacggcgccaagccggcgcagctgatctcaggccccgacgccgcccgcttcatcgtcgccggttccggcggctacggcttcatcgccaagatcggcgacatggccggccgggtgaaggccggcaaggccttcatcacgctggacgccggcgagaaggtgctggcgccggtgccggcgccgcagggcgccggcctggacgcgctgcagctggtggccgccgccgacagcggccgcctgctggccttcccggcaggcgagctgaaggaattgtccaagggccgcggcctgatgctgatggcgctggacgagggcgcggcgatgacggcgataggcctggtggccggcgccaaggcgctgctgtccaccacctcggtgcgcggcaaggccggcgatgagaagctggcgctggaggaattcatcggcaagcgcggcaagaagggcaagctgatgccgaagaaatggctggtcagcgccatccgggagctgccgatgtgatgacacggaccagccagccgcaagccctcaccccccgcgccgcgctgttgttcgtcaacggctttcgcgcgctgctgctgctggtcctgttttccatgtcgctgctgccgggcagcgacggcctgtcgctgatagaaggcggcaggcatttttatttgtggtccggcgtctacctgctgctgatcgcggtgtggttcctgctgcgcgaaggcaagctcggccacacgctgcagctgacgctggccatcgccgccgacatcgcgatgatggtgtggctgatggcgatgaacgagggtatccgcggcggtttcggcctgctgctgctgccctacctggccgccgccggcctgctgtccaccggccgctacgcgctgttctacgccgccatcgccaccctgacgctgttcggctacgccggcgtcgagcattggctgggtctgccccatagcgccgacctgtcctatagcgcgctgctggcggccgcctgcttcatcacctccatcgccacctggcagctggggaggatggcgcgcgcgtcggaggcgctggcggccagccgcggcggcgagatcgccaacctcaaccgcctgaacgaattgatcctgcaaagccagcgcgacgcggtgatggtgctggacgaggacggctgcctgcgccagttcaacctgcaggccgagcgctacttcagccgcctctcccgcggccagtccatgccggagttgctgccgctggtgcggcgctggcagcagagcggctatccggcgctgcccaccttcatcgagcacagcgcgcgcggccgccagctggtggggcggctggcgccggtgccggtgcgcgagggcgaactgcgcggcgtggtgctgttcctgcgcgacatggcggacatggcggaagaggccaagcgggtgaagctggcggcgctgggccggctcaccgccaacatcgcccatgaaatccgcaacccgctgtcggcgatcagccatgccggcgatctgctggccgaggatgaggcggaccccgcgcggcggcggctggtccgcatcgtgcaggacaacacccgccgcatcaacggcatggtcgaggatgtgctgatgctgggccggcgcgatcgcgtcaagcccgaagccatcgcgctggcgccgttcgtcgccgagctgctggagcatttctccatggcgcagccggacgccgccggcgccgtcgcctgccagctgccggccgattgccagctgcgcttcgaccgcggccacctggcgcaggtgctgggcaacttgctggccaacgcctggcgccatagcagccgcgccgccggcgcggtgcagttgcacgccagcgtggctgaggattaccttatcctgcgggtgatcgacgacgggcccggcgtggcggaagccgagcagtcgcggttgttcgaaccctttttcaccacggaaaacgccggcagcggcctgggcctgtacatcgcgcgcgaactggccgaggccaacgacgcgcggctggattacagcccgcccggtggcgtgttccggctgatctgtcacctggcctatgactaagacaccgatgcgggtattggtagtggacgacgagccggacatccgcgagctgctggagctgactctgctgaaaatgggcttgctgccggtctgcgccggcagcgtggccgaggccaagggcatgctgggcgccgggccgttcgacctggcgctgaccgatatgcggctgcccgacggcgaagggctggaagtggtgcgccacatcggcgagcaggcgctggacgtgccgatcgcggtgatcaccgcctacggcagcaccgacaacgcggtgcgggcgatgaaggccggggctttcgactatctgcaaaagccggtgagcctggcgcagctgcgcagcctggtgaagaccgcgttgcgggtggagggcggcaagccggcgcagcagcagcggctggttggcgactcgtcggccatccaggaagtgctgcggctgatagaaaagttgtcgcgcagccaggccgcggtctatatccgcggcgaatccggcaccggcaaggagcaggcggcgcggctgatccacgagcagggaccgcgcgccgagcgccccttcgtcgcggtcaactgcggcgcgatccccgacagcctgatggaaagcgaattcttcggctacaagaaaggcgccttcaccggcgccgacgccgaccatgacgggtttttccagcaggcgttgggcggcacgctgtttctggacgaagtggccgacctgccgctggcgatgcaggtgaagctgctgcgcgccattcaggagaaaacagtgcgcaagctgggcggcagccaggaagaggcggtggacgcgcgcatcatctgcgccacccaccaggacctggcggcgcgggtggaggccggcagcttccgccaggacctgtactaccgcctgaacgtgctgccgctgcggatgccggcgctgcgcgagttgcgcgaggacattccgctgttcgcgcagcagttgctgcagcgctacgccggcgacggcgcggcgccgcagctggcggcggatgcccgccaggcgctgcaggactacggctaccccggcaatttccgcgagctggagaacattctggagcgggcggtggcgctggccgccggcccggtgttgagccgggacgatctgcaactgacgccgccgcgcgaatattgcccggagccgggcagcgccgaaccgctgcaggactatctggaccgggtggagcgcgaggcgatcgccaaggcgctggacgctacccattacaaccgcacccaggccgccaaacgcctgggcgtgaccttccgctcgctgcgctaccggatggagcggctgggggtgaggtagagaagaagcgagcgcggcgtcgccgccgcgctcctggcgcaagtggttccgactgccgccgccgaggcgcggaaaggcatttgcgcggcggcgtcagccggtcgtcactggcgggcgaccttgtcgatgccgcgccaatgatatagctcgttcaatatgtataagccgacctgggcgggccagctcttgtccagaatttgcagcagatcggctactgcttccgtccggccttcgttcaggcgctgtatcaacgccagcacgcaggggaagcggttgaattcgattttatggccgcggacgtaaatgtagatcttgtcggtgttctccgactcgcgcgccagaatcttgtagggcgattcgatggcgatccggtcctgcagcgctatcttttccagcccttcgcgcgggaacgggctgttgcggtagccggcgttgctgtgcaccgagtagcgccagtcctgataggttttcctcagcagctcgctgtagttcagattcttgcattcatcggtcaggctgtatttctcgatgattttgtccaggccgctggtgtcgtccagcgagttctcgtcgtgctggaagtcttcggtcttctccaccgggatctgtttgaaaatgcgctggtgcaaatgtttcgccagcagatcgtcggtatggctgtagcgccatacggtgatgccgacggatagtccctcctgcatgccgatatggtaggtgccttccggcatgaaatacaggtcgccgctttcaaagtggaattcggacgcatacggccgcagcttggcgaaatccttgcgcgtcaggttctgcgtttccagcagattcttgtactgctctcggtcccatacatacatggttttgctgccggggccgacgtggaaatggatcacgctttcgccgcgctggtcctggtgaatgcccaatggggttttgtcgtaattgccgatgaagatggtgaattgcacgccgccgcgcgggtagccgatctcgtcgaataagggcgccagggcgacggcgatttcttttgataaggcctggttgaacttctcgccggagttcaagatgatgccgaatcgctggtctccaaataccctggcggcccacgtttccagttcttcgttttcgagcggcgcggatttttcgaaaatatcgtccatctcgttcggtcccagcagccgtccttcgatgtaaatgcggtagccgaattgcgtggttttcaatttggcgaggtccgcaatgatgctgaggacgttttgctggtggtggcggaatttttcctgggggatggcgttcttgacgacgacgggcttgctgaggttttgcgacctatccatgaaatccgcccaccaggcttcgctgaaagcggttgcgtcttttttctctatggtttcattcatggtgtttctgccctgatcaagattgaatatgaaatttccgccatggcgacgcgcgcgaagaggggggcgagcatgcgcaggccaagaaagtcgagggcggcatgccgcgatgttttgcggcatgccgctctgagcgagcgggaagctgcgatgggtggcaacttattcgctcatcaagcagacattaatcaacgtgctgttgttcttgttgcttttcttggtgctggccgccgccggataccgagatttcttccgccggagtcaggacttgaatgcccagaaagtccttgatgtcttgttctttttccagttgggcgacttggttttccttggtcatggtatttcctctattttgattaggattggaaaggcggccaatccgttccgctactgctccgctctgaacggcaattggttcagaagatgaatattcatatcaaaaatatctgcagcggttcaagccggccgcctgcggattttgtcggtaggaaagaccgcgcatcgcctggcatcgtcctgctggcgagatggttaattgtttaaatgtgtaatttaaataaacaaaatcccaatctgtagcgatggtttgattggcgatgtcaaaattatactaatgtcataaattaaaagatgcaataaaataccgccagtgtcaacggaatgcatgcgcggttgtgggtttttaacaatgcggcggcaataaacgattcgattgccgaaatgactgcggctaacgcttggggctcggcatggcggacggcgcaatggcgccgtggggggaaagtccggccgccgcgtctggcgcggcgtgcgcttggattggcgcccgcgggggcgggcgcgatgtttagcggctgggcagcgacgcggcggcggcgggaccgcgccggttcaggtagcggttgcggatgccgcgattgagcggttcggccaggtagcggccgatcaggccggctaccagcacggtcagcagcagaaagccgatgaacagcggcagccgcgtccagtagccgacggcctcgcgcggcaccagattgcgcagcagcgccagcacgatgatgtggaacagatagatttcgtagctgtgccggcccagccagcgcagcggccggctcagccgttcggacccgccgcgcagcgtcggatcggcggcggcgccgagcaggaagagcgcggcgctcaaggccagccaggtgaagccgaaggcctcgtggccggaaaagccgcgcaggtagttgaaggccagcagcagcccgccggcccagcgcagcaggcgggcggcgcggccgagcagcggccggcggcgggcgatcagcgcggccaggcagccgatggcgatggcgtcgaagcaggccaggtagccgtacaggtagtcgatttcattgtcggcgtgttggccgcggtagatcggggcgacgacgatcagcagcgcgcagcacagcgtcagcaggctgacgcggcgcaggcacacgcacagcaagggcagggccaggtagaacacctcctccaccgacagcgaccaatagacattcaggctgtagttgaaatagccgacctgctgcatcagcagattgtgccagaaggtcagcaccgagccggcggcgaccaggaagaacgacgcgggcatcgcctggccatggtccttgttgatgaagtagggcagtcccaggcagcccagcgccacgatgatggccagggccagcagcagcatcggcatgatgcgggcgaagcggaagacgtagaaggcgcggatgttgatggcggccaggctgccccagcgccgcagcgactgcgaggtgatgaggaagccggacaccacgaagaacatggtcacgccgtaattgccgttccacaccaggctcttgagcagccaggggggcaacagggtgcccagcgggctgtccttgacgccgtaggccagcgcgaaatgcagcagcagcacgcaggaaatggcgatgccgcgcagattgtcgacatggtggttgcgggagggatgatggtccatcgtgttctcctgaacgggtggcccggcgcgcggcggcgccgggggagaagggctcaggccgcggccagccgcgccagccgctgcctggggtagtcgccgtaggcccagtgctggacgcccagcacggcgtcggccggcggccgcttgcagaccagcgccatccggtaccagtgggcggcgtattcccgctggccggtgctggagtagatgtcggccaccaggcaggggccttcggcgtagcgcggatcggcgcggatcgccagcagcgcgtagtccatggcctgatcccactcctctttgagcagatggcagaccgccaggtagtaggcgctgtggaagcggccgatcgggaaattgcccagcgccagcgcctggcggtagcaggcgatggcttcgtcgaagcgctggctttcgcggtactcgttggccaggtagtgcagcgtgcgggcctcgtccggcctttctgccagcgccagcaggcacaggcggatattgcgttcgctggcgctttccttgccttgcttgttttccaggttttcgatgcggatccgcttgtcgggcagcaggccgccgccctgcaccaggtattcgtggatgcggctgcggtagtgcgcgtccggcgtgcgccggaacagccgggccgacacccagtgcgcgccgttggaggataggccgacgcctatcatgcctggatgggcgctcctgacatgccgcttgatctgggcgtggccttggcgcagcacctcgtcggcgtcgatctgcaacacccagtcgccgctggccatcgccagcgcctggttgcgcgcggcggcgaagtcggcgatgcgcccgtccgggccgttgcagccggcgtagcgctggacgcgcgcgccgtagcgctcggcgatggcgacggtgtcgtcgcgcgagccggtgtcgacgacgcagagctcgtcgtggatgccttgcaagctgtccaggcagcgcgccagcaccgcctgctcgtccctgactatcatgcagacgctgaggcgggccgggcggcgcgccggtttcgctggcggccgctcaggcatggacggctccgctgtcggcggccgcgccgcggaccatggcgatccgcccctccagcctggccaggtcgcgcgggtagctgccgctgaaattggcgtcgtcgtagttggccagcgcctggcggaacatccggtcgcggctttcccagcgcgacgccacctgcgggtagtgggcgatgcgggcgtggtcgtcgtgcgagatgtgcacggccacgccctcgttgacgcgctccaggccgcggcccagggtcaggcgggagatcatgtcctgatcctcccagccccagccgtgcaggtcggagttgtagccgcctatggccaggaagtcgtcgcgccgcgccagcagcaggccgggagcctggcgggtgccggtttcgccgtcttcctcattgtcgacgatgcgcaggcggcggccgtcggcggtgcggatgttcagttcgtagccgaaggacaccacgtggcgcgcctggcgcgaattgacttccgactcctgcacgccggccagggtgacgaagcggccggcgccttccgccaggtgggcgcacagccgccgcagcagcgccgggtcgggcaggatgatgtcgcagtcgcagaagaacagcgccggatggcgcgcctgcgaggcgccgacgttttgcgcggcggccttgttgaagaattcctgcccgtcgacgttgatgatgttcagctgcgggaggtaagcgccgcatagcgccgccagctgcgcggcgtcgccggagtagttgacgatgttgacgtcgccgccgacgccatgggccgctgccagcaggctgggcagggcctgcgccagttctttgcggttgcgccaggaaatgatgatggaaagcatgcggtttctccggaaggcttaatgggggcggagcgcggcgaattcggccaccttggcggccagcgcctcggcggacaggccgtggcgcgcgcgcagcgcctcgtcggagccggacttgccggcgtagtccgccggccagccgcaggcggcgatcggcgcctccagctgcaggccggccagcagcgaggccaggccgcccatcacgcagtggtcctcgatcgccaccagccggctgacgcccgccagttcgcgggcgatggcgtcgcggtcgcccaggtaggggcagtgcagcaggccgacttccatgccttgccgctgcagccgttcggcggcttcccgcgcccagtggctgcctagtccggtcgacaccagggtgagcgggcgcggcggcagcagccagcgcagcggcgcggcctcgcccggcaactgctcgtcgtagccgaaggcgcggcgcggcatgcggatgtagttggcggacggactttgcaggcaggcgcgcaccgccagctcgacgtcggcgaaatcggccggcgcccagacctcgatattcggcagcgacagcatcagcgccagatcgttgatcgcggcgtgggtcttgccgttgcgcgcggccaggccgccggcgtgcgagcccaccatggtgacggcctgccggcattggctgaggccgatccgcacctggtcgtaggcgcggtagcacaggaaggcggcgaaggagaagacgaagggccggagcttgcaggacgccatgccggccgccacagacagcatgttctgttcggcgatgccggtcatcaggaagcgctgcggatgggcttcggcgaagtgcatggcgccgtcggaatcggccaggtcgccgtccagcacgaagatgcgctcgtcgtccgccgcgcggcgcgccagggtgtggccgagatagtctgccagtttcatgctcatgccaggctcctcagcattatgtcgtgttcttcgtcggataccgtctcgcaatggaagcgccacggcgccgcctccaccagcggcacgcccttgcccttttgcgtgcgcgccaggatcacgctgggctggcccttgtggcgttgcgcctcttgaactgccagctccagcgcctggtggtcgtggccgtcgcattcgatcacgtgccagccgaacgcccgccatttggctgccatctgcggcaccggctccgggtgcggcgcgtcgggcgtcggcgcccagccccactcctggaagcggttgcagtcgacgatggcgtggatgtgatccaggccgcaggcggcggccagcatggcggcttcccacacctggccttcctggcattcgccgtcgcccagcaccacccaggtgcgctgcgccgagccgcgcagcgccagggccatgcctatgcccaccgacaggccctggccgagcgagccgctggagaagtccactcccggcacgctcagcatgtcggggtggccttcgaggatggagtcgaagtcggcgtagttgtccagcggctcggagaagaagcccagccgccgcagcaccgcgtacagcgccaccgcggagtggcctttcgacaggatcaggcggtcgcgctccgggtggccgggcgcggccggcgccacccgcaggcagcggcggtacagcaccagcagcaggtcgatgcagctgaggctgccgccgtaatggccgccgccgacggcgtgcagcgcgcggatgatgtccaggcgcagcgccttggcctcggcggccagcgtcaggccgtccggcgcggcggcgtgcaggatgggggccgaggccggatgcctggccgccagcggtgcggagatgtctatggtcatgattagcgtgctacccatcgttggtgccaggcggccagcgtcgccaacacccacatctgcccgaagcaggtgaagtgcgcggccttggcccggggtgtgtaggatcgtatctgcgcctcgacttcggacaaccagccgcgctggacgaagccgctgtcccacagcggggcgtcgcgcagttgcgcatagatggcggcggagaagtccgggtgttgcatccactgcgcgatcggggcgttgtagctgtacagcgggcgctgcatgatggcgtcgggcacccgcttggcggcgatctctcgcaacactttcttgttgcgccagcggttgtccttgcgccagaagcgctcggcggcgcccagtccgcaggcctgctccgccacttccggcgcgaggaagggataggcggtgtggatgccctggcttctggccggaggctcgaagccggcgaacagcaggtcgggcacccggtgctggcactcgtgggcgaccatcagctcgaacaggtgggcgtccggcttgtagcggcggcactggcggtaaaactcgatcagctgcggcgcatggctccacgacttgtacggctgcggcagcgccgcccgcagcgcggaatcgggatggaagcgcggaatgccggaaaacaggcgcgagcgcgccggcgtcggctgccacatcaggccatcgatggagtcgacggcgtcggccgccggccagctttcctcgaagaagcgcagcttggcgtacgactggaagaacttccagtagccgccgaacacctcgtcggcgcccagtccggataacaggctgcggtggccgtcggcgccgatccgcgccagcaggtggcggtgggtgatgctgctccaggcgctgcagggctcggcggcggcgaacacgtcggccagcgcggcggtggcctgctccgggcccagctccaccgcgtggtggcgaatcccgtaggcgtcggtgacgatgcgggcgtattggctttcgttgtgggggtagggcgcggtgaactcgatggtgtaggcgtcgaggcgttcgccgccggcgcgcatggcggcggtggcggcgatgtaggaggagtcgacgccgccggacagcaggatggcctggccgccgtcggcgagccgggcatggatggcctggtccagcgtgcgctccagctgctcgcgctcggcggcgcccaccaccttgggcgcgtcgaagcctattggggtgtagtagcggtggctgagcagcgggccggcgccgttccaactcaagtagtgagcggccggcagtttgctgacccggcgcgccagcgtgcgtcccggatagggcgcgccgaacatcaggtaatgcaccgcggattcggcgtcgagctggcagtcgaaatcgggatcggccagcagcggctccagttcggaacacaacaggtaatgatgggcgtcttcgcggatgaacaggctgcgctggcccatctggtcgcgcgccagcagcagctggccgcgcgcctcgtcccagaacgccagcgcgaactcgccggcgcagcgctcgaaggcgcgcgcgccgtcgcgctgcagcgcctccagcgacagcgcggcggcgccgtaggtgcggccgcggcagcacagcgccgactggccgccatgcgggccggcgctggtttgcggcgcgtgcagcgccaggccggcggctgacacgaaccagtcggcgccggcggccgggaaggtggcgggcagccgctgccgccagtggccggcgaagtcggcgcgggcgacggcggttttggcgatcaggccgtaaatcggttcggcgctcagcatgccggccgctccaggtggcgttgcagcaattggaagcgcggcagcgcctcgtccggatgcatggggtccgccagttcccgcagcggcgccggcagcgcggcgcgcaaggcgtcggtgaagtgggcggtgccgtcggcggcgatatcggccaggccgtcgccggcggccgcttcgcgcatatagggcagcatgtcggccggctggatgccggcaggcaggtcgagcgcgacggcgccctggcccacccgcaccggccagccgccgggcaagccgcgcggaccgggcgcggcggtgagcaactccggcgcgccgggcagcagcgcgtcgatcaactgcagcgcgtgggcggccgatagcgcgttcaggtcctggtcttgcggaatggccgggccgcggtacagttcgccggcgtccagccgctcgtcgcccaggtacagcagcggcggcggcaggccgcgcgccgcttgcggctcggccctcaccaccgcgccgacatgggcgtgatgggcgaagacacgcagcgggcgggaggcgtcggccgcgcaccggcgcgccagcgccaggatcatgccggcgttgcctatgcctatggtcggggcgagtcccagccgctccaggatcgggtgggtggcgtccgggtaggaacagttgaccaccgggcaggagacgccgctgtcgcgcacggcctgcatcaggttgcggatcaccggcagctgggccggcagctgcagcgcgaagccggcctggcgcagcgcgaccgcttgcgggtcatcgcgctggaacagcgcccacggcgacatcaggctggccgcctgcacgatcaggtcgggacgttcgcgctccagcagcgcggcgaggctgtcggcgtccaggccgtccagcggaatgaagcgttgcggcgtcgccgagcaggcggaggacaggcgggcgaaggattcgccgcggccgcggtcgcggctggcgagcagcagggagaggtcgcgattcagcaagggcagggtcagagccaatcggcgtcccagatcgcccaatcccagaatgagtatcttgtcttgtttcattggcaagcctggtcatggccgcttgttcagtccgggcccgggtgctcgggcggatcggaccggcgggccggtattgcatggcgcctggccgggcagaaccggaaagcgagcggggctgcgctttccggtggttcaggggcggtgaggcccgtgaatgcttacttggtgctttccgaaaccagcttcaggtattgagcctggatttcgccggatttggtgttttccgcgcgcagtttcaggtacttggcggagatttcgccggcgccgccgctgacttcgctgatttcggtggcatccagtgttttcaggtcttgctggttcatggtaagtcctccttgaatgtcttccggtattggaagatcataagttttgcaatcgtcatgtttgtttgtcaacatattggactattcgcatagaaaaatctgccagccacgtgccaaatccacccactcctgaatccgcggccagcggcagccgcttgttccgcaaggaagcgctgcgccagctggatacccaccgctatggcagcatcgtgctgaaaaggccgatcagcctggcttggctgaccggcttgttcagcctgatcgcgctggccatcgtgctgttcttctgcctgttcagctatacccgcaaggcgcaggttgccggcgtgctgctgccgacccagggcttgatccgcctgctgccgtcgcagtccggcacggtggcggaggtgcgggtcaaggaggggcagcgggtgcaggccggcgaggtgctgttcgtgctggccaacgcgcgcgccagcgccaccaagggcgacgccgagggcgcgatcacccggttgctggagtcgcggcgcgacagcctggccggagatcagggcatgctgcggctgcaggcgcggcaaaagcaggcggccttgcagcgccgggtggaggatctggacaaggaagtgcagcgcatcgacgagcagatcgcgctgcagcggcggcgggtggcgttggcggaggaaaccgtggcgcgcaaccgcaagctgcaggaggccaatttcatctccgcggcggggctgcaggacaagcaggccgaactgatagaccagcaggcccggctggccgacctgcaacgctcgcgcgcggccacgctgcgcgaccaggacggcagccgcgccgacctgcgcgacatccagacccaggcgcagcgcgacgaggcggcggcccagcgcagcgtcgacagcatcgagcaggacctgaccgagaacgaggcgcggcgcaagctgctggtgcgggcgccgcaggccggcatggtcagcggcctgaccgcgcagccgggccagacggtggcggccaaccagccgctggccaatctgtcgccggcggggtcgccgctggaggccgagctgtacgcgccgtcgcgcgcggcgggcttcgtcaggccgggcatgccggtgctgatccgctatcaggcctatccgtatcagaagttcggccagttcaagggcacggtgcgcgaggtgtcgcgcagcgccttgcggccggaggagctgtacttcaccagcccgggggccagcccggacagcgaggcgctgtatcgggtgaaggtgacgctggagcggcaaagcgtcaccacttacggccagtcgcagccgttgaaggcgggcatggcgctggacgccagcgtgctgctggaaaagcgcaaattgtacgagtgggtgctggagccgctctacagcatcagcgggaaggtgtgagatgagccatcagcaacccgtgctgcaattctggggccgcaagcgcctgccgctgctgctgcaaaccgaagccgccgagtgcggcctggccagcctggcgatggtggccggctactggggcctgcggatagacctggccaatatgcggcggcgtttttcggtatcgctgaaaggcaccacgctgaaaagcctgatcgcgatggcgcagggcctgggcctgcagccccggccgctgaagctggacatgcagcatctgccgcagctgcagctgccttgcgtgctgcattgggacatgaaccacttcgtggtgctgaaggcggtggccggcaagcacatcgtgatccacgacccggcggtgggcgagcgcaagctgccgctggccgaggcgtccaagcatttcaccggtgtggcgctggagctgacgccgggcaacacgttccgcaaggccgaggccaggcagcagttcagcctgctgtcgctgatgggccgggtggacggcttggggcgcggcatcggccagttgctgctgctgggcatcgccttgcaggtgtgcgcgctggcggcgccgttctatctgcagtgggtggtggacgaggcgctggtggcggccgaccgcaatctggtgacggtgctgggcatcggcttcctgctgttggtgctgctgcagaccgccatcggcgcagtgcgctcgtgggccgccacggtgctggccaccagcctcaatttccagtggctgggccatgccttcgcccatctgctgcgcctgccgctgccctggttcgaaaaacgccacctgggcgacatcgtctcgcgcttcggctcgatccaaaccatccagcgcagcctgaccacccagttcgtcgaaggcgtgatagacggcctgctggtgttggccaccttgggcgtgatgctgctgtacagcccgtcgctggcggcggtgagcctggtggcggtggcgttgtacgccttgctgcgctggagcatcttccgcgcgctgcgcgaggccaccgccgaacagatcgtccacgcctcgcggcagagcacgcatttcatggagtcggcgcgcggggtgcagagcgtgcggctgttcggccgccaggaggagcggcgcatcggctggatgaacgcgctggccgagcagttcaacgccgatctgcgcatttcccggctatccatcacctttcaaaccgccaataccttgctgttcagcgccgaacgggtggtggtggtgtggctggcggcgctggcggtgatggacaaccgcttttcggtcggcatgctgttcgccttcctcagctacaaggaccagttcagccagcgcatcgccgcgctgatcgacaagctgttcgaattgcggatgctgcggctgcacggcgagcgggtggccgacatcgtgctgaccgagccggagccggagttgaacgatgtggagctggacccggcccatgtgcagccgacgctggaagtgcgcaacgtcgccttccgctacgccgacagcgagccgtatgtattgaaggacctgaacctgaccgtgccggctgggcagtgcctggccatcaccggcgcttccggctgcggcaagaccacgctgctgaagctgatgctgggcctgatggagcccaccgagggggaaatcctggtgggcggcatccagttgaagcagctgggcctgtccaattaccgcaagctgctcgggacagtgatgcaggacgatcagctgttcgccggctccatcgccgacaatatctgctttttcgacccgcagcccgaccaggagcgcatccgccattgcgccgggctggccgccatccacgacgagatcatggcgatgccgatgacctacaacacgctggtgggcgacatcggctccggcctgtccggcggccagaagcagcgcatcctgctggcgcgttcgctatacaagcagccgcgcctgctggtgctggacgaggccaccagccatctggacgtgtggaacgagaaactggtcaacgccgccatccgcaatatatccatgacgcgcctgctggtggcgcaccggccggaaaccatcgccatggccgaacgggtggtggtgctggagcaggggcggatcgtgcaggatacgacggtggcggccgcgccggcctgcgcgtcggcaggcactgcgatctgagccgcggcgcggccgttacggcttcgcggccggcgcgcgcggcatcagccgcatcgccgccacttcctcctgcagccattcgacgaactgccgcatcttgggctggtcgtcgcggcagaacacgctgtagccatagccggacggcagggcgatatggggcagcatgatcagccggccttcgacgatatcttcgtaggcgaggcagtagggcagcaggccgacgcccaggcccgccaccgccgactgcaccagcaggcctgaatggctgtactgatgggaaagatcgtagcggtgccggtctaggccatggacattcagcaaggtgtgccaatgttcgggcgaatcttcatacagcagcgggtagcggagtagctgctgcagggtgaccggcccggtttccgttaccagattcgggctgtaggccacgatcaggtcttcgctgaccagcagcgagttcattgcgtccctttgcagcttgtgatgacggatggcgatgtcgcacacgccctcttgcagcgtgcgcagggcatcgctggagtcgatgcgcagatcgaagccgggaaagcgttcggtatagcgctgcaggcgcggaatcagccatttgatggcgaacgaatgggtagcggtgacatgcagcgtctgggcgccctcggggactctcagcattgagattttggcgcggaggtcgtgcagcatgcgcgtgatcagctgggatagctcctgcccttgcggcgtcaggcaaatgtggcggggatggcgctcgaacagcgaaatgcccagcgtctgctccagttgcttgacttgttggctgatggcggcgggcgtcttgttcagctcggccgcggccagccggaagctccggtgcctggcggcgcactcaaaatctatgatgccggatagcgtgcgaagatgcggatccatgctgactgtcaccaatgaggcttatttattaaggcttggccgcagttcgacgggccggcgcgctgattgccgggcgccagcgcgccgcagcagtatctctgtcaggacgcgaatggtcacgcgacagaccattatatgaccattgagtgacgatgcatacgtttggcatacactattttctcggccgccgcctggcaccgtgcattagcaaaactctcgccatgggcaagaatttatcgcgcgacagcgcggacgggccctgcgtatattgggccggccgtcacgcggggcgcggatggctcgcgcgcgggatgcgccgatctttgccatgtcaagccaggaaggtatgtatgcaaactgcggatgtgtttcatctgatcgtggccatttcggcccgcacgccggccgatatcgagcctatcgccgatgcgctggcgcgcatgcgccccacatgtctggcggagcccggttgcctggcgtgggaggcctaccactccgccgatgccgcggagaagttctatctggtggaaacctgggcgtcgcgcgccgcctgggaggcgcatggagaactttcggcgatccaggacatttacgtgccggagatcatgccgcggatcaaccgcgaagtgcatccctgctcccggatcggttgaagcgttccggcgcccgccatctggtttgaggaggcgtcgccctttttcagcattagaaaaacttgtgcaatgccgggcaaatagtcgttcgacacgatgcgaggccccgcctacgcttggcggatcgatgcccgcgccgatcggcgcgcggcggatggctcgtttttcaatcatcctgaaggtgaggcttggacatgtctgcacaaaaggtcgccctgattactgccgcggggaaggggatcggcgccgccatcgcgcgtgatctggcgtcgaatggttaccgggtggcgctgatgtcgcgctcgaacgcggccattgaattggcgcgcgaactcggcggcgtcggcgtttcgggctcggtcaccgagttcgccgatatgcagcggctggttcaggccgcattggacgcttatggccgcatcgacgcggtggtcaacaataccggccatccgcccaagggcgacctgctgtccatcccggatgaggaatggcatcgcggcttggatctgctgctgctcaatgtgtcgaaactgatgcgcctggtcacgccgatcatgcgggaacagggcggcggcgcggtggtgaacgtgtcgagcttcgccgtcgaggcgcctgagctcggcatgccggtgtccgcggtgatccgggctgggctgagcgtctggacccggctgtacgccgagcgccacgcggcggagaacattcgtatgaataccgtcttgtccggctttgtcgacagcgcgcctttcgatgaaaaacgcgccgcttccatcccgatgggccgctatggcgataccgccgaattggccgccgcggtgcgattcctgctgtcggcggaatcttcttatatcaccggccagaacatccgcgtcgatggcggcttggttcgggcggtttaagccgccggcgggctgcggccaacgcctcactacatcgggagacattcatgacgaaacaagttctggtgatcggcggaacccgctatttcggcaagcggctggtcgcgaaactgctggcggccgggcatcgggtcaccatcgcctcgcgcggcaacgccgccgatgatttcggcgaccgggtcgagcgcatccgggtaaaccgttcggatcgggccgccatgacgcaggcgttcgccgatgcgcgctacgacttggtctacgaccaggtttgttacaacccggtcgatgccaagctggcttgcgatgtgtttgccggcaaggtggggcgctatgtgatggcctccaccatcgaggtctactatccgctgcggcgcgccgtgcagcggccgttccgcgagctcgatttcgagatgcggggcgagctgctagagatgggaacatcctggcacgagatggcgacgccggatcaaaactatgtggccgggaaaaggcaggccgaggcctgcttccatcaggacggccgcttgccgctggtggcggtgcgcatcgggcatgtgctggccgatggcgaggaggaatttctggggcgtgtcgccagttacgtcgagcgcgcgcgccggggcgaacgcctgcggtatgcggtggcgtcggggcgcagctcgttcatccacgccgaaagcatcgcggatttcctgttgtggacaggcgagcaggcattcctggggccgatcaacgcggctgacgatggcggcctgacggcgctggagattcatcaacgcgccgccgccgccctgggcgtgccggcgcatgccgaagccgacctggacgaggaggctgcgaccaggctgagcgtcttcgactttcctttcgagtatgagatggataccggcagagcgcgcgagctgggctaccggtttgcggatgtggagcaatggatcggcggcgtgttcgccgggcatgctcaagcctgattagcggcggtcgcacgcggcggcgctttcgcgccgccgtttctttttcttcgtttccctcgtgttctttcccggctttccttcgggcggctggcttccgcgcgccgccgtcgcgtccgccatttcgcggcgaggcgcctgcaatcccaaatgggatttattttgaaaaaataaacatgacgttagtgtggccattttgatggcaagctcgcttgaaaataagactaataaagacaattcaattcagtatagaatgaagttctatttcaattccctgttttagatgagttttgtcgagagaagatcgggcaagaataacttgagcttagccattggcataccttttattttcctaaatgaaaatgtatggagatgcaattaattatgacgtatgattctttttgagatttgctggatgagtaggaaataaattctaatttcatgaaaccatatgaaaatttctggaatatagatttttttatccaagaattttcataaatgcctttattttggttttttaaattagttgatcctaatttatcttccattgccagggttggcatcggggcgaactggttcgcatggcgctgatgcggattcgcatattgggcgcgcaggccggacggcagatcttgtttctctatattggctggttttggtcggggccgtcaggcatgcctgaacagcgtccgaatcttggcggactgagatcaagggccgttcgggattggcgatggccgcgaccgatgtgaagccgtttttcaatatctcgcatcgaatggaagatcaaatgagtaatgaatgtctggtttgctccgaagccgtcaacatcagcgcggatgtgctggtaggcgaaatcatcgcatgcggcgcatgcggccaagaacacgaactgctgatggttgatggccagcccaagctggccctggcgccggaagtggaagaggactggggcgagtaagcatgtcgcaaataacggtactgctgattctgaccaagatgcggccggaagagaaggcgatcgtcgaggcgctggagcgccggggcgtcaaggtgatcgtcagcgtggacggcagggatctgggctggctgttgcagggcgagagcggagtcgggcatccgcaggttgcgatgctgcgttgcttgtcgcaatcgagaaacgtcgagttggctcggttgctgagggcttgcggcattccgaccatcaactcggtcgatgcgatcgacatttgttgcagcaaagtggcgcaggcgatgctgttccggcagtacgacattcccgcaccgcagtccgtgatcgccttccaagccgatgaaatcacgcgctatggacagcggcacggcttccacttcgtcctcaagccggcttcttcatcctggggacgcggcgtgacgctgatccgcgatgaagaggcgctggaggcgtggcggtcggcgtgggaaacacatgatgcgctctacaagcatttcccggtgctgatccaggcttttgtcgagaagcctggctacgatctgcgcgtggtgatcgtgggcgagcgtcccatcgtggcgttccgccgcgctaccgatcactggaaaaccaacacgcacctgggcgcgcaagtcgtgccttgcgaggtgaccgacgcgatccatgatctgacgacccaggtggtggaggcgatcggccccggcatctacgggctcgatatcttcgagcaagtggggtcggacgaattgctggtctgcgagatcaaccagaatccggaattctggcgttcgtcgcagattcaccaggtggacgtcgccggcgcgatcgccgactgggtcgcggccgacgccgccacctacaacctttctttccaagtcaattccgctacatcgcttgcaatggtggcttcatgaacaacttccagcaatcgctcattctctcgcgcgtgatgaccagcggcgtggtgatgagcatcgagaaaaacgaccggcaattgcccggccttgaaagcctgattcgcagcaggacgggcctgcagcatgtcgcgctgttcaactccattaccggcgccattcatggcgctctgcatggccaaggcatcggccatggcggccgcgcggtattccccggcatttcggaacgcgagtacaagtttctgacctggctgggggtgacattcgaagaaacccgcgccgaaccgagaacctacggcctggcgagcgtggcctggcgcgatgagcagaccgacttcgccgccgctgcgacccggctggcggatgacaaggtgcaggtttatgacttcgcggcgctgggtttcgggccatgcgccgccatcgccaccaacgatgagcaggtgtggaaacgcgccgagcggctgaagatcttcggcgccttcgacttgcggaccatgtggtcccaagccgaaagcgagccggatatccagccgaccatccaattcaactaccgactgagcccgctggttgccgcgtgcgttcgtcaggcaatccaaggggactgatcatgcaaaccgattttccggcactgccgctgccgtggccgacagatagcgtcctgcgcgacgaactggcgcatcttggcggtccgcctgtcattggccaaggcttccgccgcaccctattcccggtgatcaccaaggaagatgtgctgcagatgcagatcagcatcctgcgcaatcattccacgtcggtggcgcagttcaccgaggactaccgccagtatgtcggcgcgccgttcgccatcgcgaccgccagcggcacgtcttcgctgcacctggcgctgatcggtgccggcgtggagccgggcgacgaggtgatcgtgccttgcttcaccttcatcgcgaccgctcaggccatcgtggccgccaaggcgattccggtgttcgtggacatcgacccgcagacctactgcgtcgacgttgccgcggtggaagccgcgatcacgccgcgtacccgcgtcgtgatgcccgtgcatgtgcatggcctgccggccaatatggcggcgttgcgcgacctctgcgaccgccaccagctggcgctggtcgaagatgcttcccacgcccactccgcctccatcgacggcaaggtctgcggctcgctgggcgatgctgccgggcagagcttgatggcggataaaaacttcccggtcggcggcgagggcggcatcgccttcttctccgacgaggagaaataccagcgcgcgctcaaattcctggaaacctcgggcatcgactacgcgatgtcgggcatcgtcgcctccttcggcatcagccagctcaagcggctgggctactatgacgcgatccgccagcgcaacgccgactatctgaccgcgcaactggccaccaccggcctattcagcggaccgacggtgccggccggctatgtccattcctacaatatgtaccggatcaagctgcatccggccgccgccggcctggacgatctgcccgtgcatgcggtgaaggccgcggtgcaggagctgctgctggccgaaggcgtgccggcgcgcgaatggcagaaccggccgattccgggccacctgcccttccagaaccgcaccggtttcggcaacggctatcccttctcgctcagcgaccgcgacttcagcgaataccagatcgagcgcttccccaacacgctggacatgctggaatcgaccctgaccctgtgccgcgaattgcgttctccggtagagaccgagcgcatccagtcgtacgcgctggcgttccgcaagatcgcggcgcgtcctgacgtgatccgcgagctggcgacgaagggcgagtttccgctgccatatcaacgcgatagccgcctggggtaatgatgaaaacggtaacggtatccgttttgggggccgcgggcttcgtggggggcgagctgatccgcctcctgcagggccatcgccatgtccagctggtcgacgtgacgtcccgcgcccgcgcgggccagccgatcggccggaccatcccctcgcttcgccactttcccgaaaccgggcggaagcggttcgtggcgatggagtcgatgcagcctgtcgacatcgtgttttcctgcctgccgggcggtgcgctgcccggcatgctcgagcagattcgcggcaaggcgcgccggatcatcaatctcgccggcgatttccgtctgcgcgatccggagctggtcgccaagcactatccgcagacggccgcgctgggaatgccggcggatgcgcgctacctgattccggagttctggcaagccgagtatgccgatgcgccgctgcttaatttgccagggtgcatggcgatcgcgaccttctattcgctgtatccgctggtggcgcggggcctggtcgagtcagacatcgtcgccgaggccaagaccggctcgagcggcagcggcaaggagagcgcggagcacccggccgagcgcggccataactaccggccgtacaaattgtccggccaccggcacgagcccgagatcgtcgaggccctggccgaacacgccggacagcgggtcgacctgcgtttttccgccggcagcctggatagcccacgcggtatttcggtgtcgtctttcttcaccttgcgcgaaggcgtgcaggagctggatgtgcgcaaggccttcatgtcggcctacggcaacacgcgcttcatccgttacctcggcccggcccagggaccgtggaatatgccgatgctcaaaacggtggtcggctcgaacgcggtggaaatcgccaccgacacggttggccgccgctgcacggtggtcagcgcgctggacaacctgatcaagggcgccgccggccaggcgattcaggcgatgaatctcgccgaaggcttcgacgaggcggaaggactagcctatggaggaatgtggccatgacagcgcttttcaatccgggatccgttcccgcgcaggcgccggcgccgggagcggccattcccaaaagccggatgccgctttatgtcatcaaggtgggcagcgccacgctggatgccggcagcgcggtattcggcgaaatcgcggccttggctgaaaccgggtgccgcgtgctggtggttgtcggcggcggcagcgccatcgagcggcaatatgccgccgaaggcctgcccttgcgctaccacacgctggccaacggcgacgcggtacgcaccgccagccgcgaagatatcgacctgttggtgcggacctaccgcgaccaggtgatcccgtcggcgctcaagggcttcgccgacgcggggctgcgcgccttcgcggcgcccggccaccagttgagcttggtcaccgcccagcgcaaccgtccgatcaaagtacaggtggacggcaaggcgttggtggtgcgcgaacatctggtcggcacgccggtcgattgccagcgcgcgctgctggggcatctgctcgagcagtacgacgtggtctgcctgaccgcgccggtggccggcgccgacgacgccgccgcggtgctgaataccgacgccgatatgctggcggcctttctcgcgacggcgctgcaggcggaccatatccgcttcgtcacgtccacgccgggcatcctgcgggatatcgacgaccccgagtcggtggtcgccgatatcttccccggcgtcgaactggacttcgtcaagggacggatgaagcagaaaatgcgcgcggcgcggcatgtgatcgagaacgggatcgccgatgtggccatcgtcggcccgcactcgttcgcgcaggcggccggcgtgacccgggtatggccgctcccgccgccgcacccagcgctggccagcctgacgaaggcggtttccatcaattcggtgtcgagggacgaggccgagatcgcgaaatggctggtggcgtattgccggcagcagggcgtggacgcccatgtcgacgcggcgggcaatttcgtcgccagcaaggggaatggcccgcagcatctgctgttgctggggcatatcgacaccgtccccggcccgtggcggccgatcctcaacgccgacggccatttgagcgcgcgcggcgtggtggacgccaagggatcgctggtcaacttcgttgaaaccttgctggcggccagcgtgccggagcacggccgtctgacggtggtgggcgcggtcgaggaggaagtgtcctcgtccaagggggctttccatattcgcgacagcctgatcgccgacgcggtggtcatcggcgaacccagccgcgccgatacgttgacgctgggctactacggcttgctcaagatacgcatcatcgcctcggtccgccatgcgcactcggccggtaaaggcgtggtgtcggcgccggacctgatggtggaaacggtggccacactgcgggactgcgcggcccgtttcgatccggaaggcatcagcgcgctgatctcgaccaaaagctggagcgactccaaccggcagcacgccgaggggatactcaatttccgcgtgtcgccatcggcggatttgccggccctgctggcggcggtcgagacctgcgcgaacgaagaggtgcgctgcgatatcgagcgggcgacgccgggatacggcaccactcggacctgcgagctggcgcgctgcttcggcagggctttcgcctcgcaggggatcgcgccgcgctacgtggtgaagaagggcaccagcgacatgaacacgctggcgacgcgctggactggcgtggacatggtggcgtacggcccgggcgattccgcgctggaccataccgaccacgagttcgtgaccgccgaggagttcggccgggcgcgcgaggtgctggatgcggcggtggcgcagtggttcgcggtgcggggagggcggcaatgagcgagatcatcgaaaccggcgcccagtccgccgcatgggacaaggtcgggctggacgaattgcagcgccgcgtgcggcgcaccatcgtcgacctggcggcgacgccgaccggctgccatatcggcggcagcctgtctgtggccgacatcctgatcgccgcctttgccagcgtagaccgcgcggcgggtgacgaggtgatcctcagcaaggggcacgccgctgccggcctgtacgcggtgatgcaccacctgggcatcatgccggaggacccggtcgccagctatggcgcggccggttccatcctgaccggccatcccaaccacaagatacccggcgtgcgcttcgccaccggcagcctgggccacggagtggcttacggcgtcggctgggcgctagcacgccggatcaagggcgaccggcgccgggcgatcgcggtggccggcgacggcgaattgcaggagggcctttgctgggaggcgttccagctggccagcggcaaagggctgggtaacttcatcgtgatcgtcgatcgaaacggcgggcagaacgacggcgcggtcgacgagatttcgccgatgccggatctgctcaggcgtttcgaggccttcggcttcgattgcgcgcaggccgacggccatgatccggcggcgctgggcgcgatcatcgatgcgcatgacgccaggggcgaccggccgctggccatcgtcgccgataccgtcaagggcaagggcgtcggcgcgatcgagaacaatcccgcctgccactatgcggtgctgaagccggcagtcgccaaaaaatggaaggagaccatcgcatgagtctggctggtcgaattgcttatcgggaagaactgacgcggctggcggtggatgacgccgccatcgtctgcctggagggggatctgggtggcgccaagcatccgttccagagcgcccatcctgaccgtttcttcaatctcggcatcgccgaagcggccgccatcgattgcgccaccgcgctggccttcaacggcttgacgccgttcttcagtactttcgcgccgttcgcggtgctgcgcgcggcggaaagcatgaagctgtcgatgggttatatggcggccaacatcaaggtggttgcgccttacgccggcgtggccggcggctggttcggcaccacgcaccactgcctggaggatctggccatcgtccagtctttccctggcatccgcatcctggcgccttacggcgaggaggagacgcgtcaagcggtgcgcttgatggccgaaaccccgggcccgttctacatgcggctgggcagaaacggcgcctatgccagcctggacggagaacgagaccggcacggcatcgtctggcaggcggcctccggttcggccgcgccgacgctggcggtggtctccgccggggaaatggccacggcggcggtgttggcggcgcgggagcagggcgccgaattcgcgcacgcgcatttgtggcggctggatagcgaggcgctggcccaggccgcggcgggcttggccggcttcgatgccgtgctggtggcggaggagcatcgcgcgcaaggcggcatcggctcggccctggcgctgctgttgccggaagtccgcgtgcactccttcaattgcggcgagggctggcccggcgtcggcggctcgcacgaggaagtgctggcctcgctgggctttaccagcgagtcgctgcgccagcgcatagaacaattgctcccggccgctgctcggcgcgccggcgacctatctcattgaacaaggaatcaaaaaatgcatatcttgatgatcgaatgcaatcccaatggcatcgccggcatcgcaaacgcgctggaactgggccatgacgtcacgctggtctcggcggacccggatttctacctgaacgtatcgccgctggccaaggccgctttcgagcatcctcgctgccgcgtgatcaagtccgacgacgctttcgtcatcgatgcgctgctggcgttggccaagcgcctgcatgccgagaagccggtgcacggcgtggccacctatagcgagtaccacactgtccacaccgccaccgtggcgcaggcgctgggcctgccgggcatgagcgtggaaggcgcgctgaatgcccgccacaagcaccgcacccgcaccaagctggccggctccggcgttcggcagccacgcttcgcgcatgtcagcgacccgcagcaggtggaggcggcagtgcgcgaaatcggtttcccctgcgtggtcaagccgtcggatggcacggccagcctgcatgtgctgcatctgaccaatgaaaaagacctggagcaatacctggccgagctggccaagatcaccgattacggccgcggcgtggtgcgcattcctgacatcctggtcgaggaattcgtcgagggcgagctggtgtcggtggaagcctgcgtgcagcagggcggcaaggtggtcaacctgggcatcaccgaccgcgcgctgagcggtttcccctacttcattgaaatgggcgccacctatttcaagggccatccgctgcaggacgagctgtttgcgatgaacgagaaggtgctgacgcatttgggcgtggacttcggcttcatccacaccgaatacctgctgagccaggatggcccggtactgtgcgaggtcaacggccgtctgatcggtggcgttgtgcccagcctgatgcaactgtccagcggcgtggatccgtacctggaagtgatccgccaggcgctgggcgagacgcccgagcatccggtgcccggcgatgtcgtcgccagcgtccggtggtttggctcgccggtggacggcacgctgtccaagatcgacttctcccaactgaagaccttgcccggctatcacgatgcgctgagctaccgggcgccgggccgtcccgtttcccgtctgtcgaagagcaatttcgattggctcggccacatggtcttcaccggcgatagccgcgagcaggtcaatcagcgctgcgaggccgcgctggacagcattcatctggaactggcggtaggggtggcgaagtgagcgcagccgttgccgaaagcaggccggcgacggctgcgggcgacggcgcccgccgcgcgctgcgccgggtggcgattccggtgcttgactcgtcgcagctgttcgatgtggaggtggaggatgggcattttgcctccatccgggcggtcggcgaaacggcggccggcgccaagccggcggccagtctgtggccggggtataccgagtgccatgcgcatatcgcgctgcccgccaatttcgacgacagcatagacgagcctgaactggtggcgctgcaatacctctaccacggggtgacgcaggtggtggacatgtttgggtttccgttggtccggcagcgctggcaggacgcggcggcggcgtcctggctgccctatccggaggtggcgcactgcggctacgcgattaccgcgatgtgcggctatgacggcaagggcgcgcacggcaccgagtttccgtcgccggtgttcatgctgggctgcgagagcgacctggatacgattctggaggccaacgccaagctgggcgcgagcttcctgaaagtgatgttcaccgatggcgtcgagcagcctggctcgccggtcaagttcaaccggctgtcggcgccgctgctggaggcgctggccaaggcggtggcggcgcgcggcatcccttgcgtgctggactgcaatacgcgcgaggaggtgctgctggcctatcgcttcggtttccgctatttcgcccacgccgtgcgcgatgtcgaactgagcgatgccgactgggcgaacctgccgggggcatccttcgtctcgacgctgtcgggcttgcggccgatggtgatgagccgcgaggagtttctggacgaatatggccatgccggcttcgtgcagacgcaggatgcggcgaacctcgatttcgtggcgggcatcgagcagccgttcggcgtcgcccgcaactgtttcgaaacccggaccggcgcgctgcgcgccatgcggcagaacagccgcgccgcgctggcccgcggcgccctgcgagtgggaaccgacgccggcaacgccggcggcttccatggctacagcctgctggccgaattgaggctgctggcggagcggcggggccgggccgacgtcgcgctgcagaccaacgcctgtctcgacggccgccgctttttcgagctgctggctgggcgcgccgccactgagccgttcgcagtcggggccgccgcgacgttcaacctgtttcgcgacgccgatgcggcgaccggcgccttgccggatgagaccgtggtccgcggcatcgcggtggaccgcgcgcgcatcgcgcaattcattcactccagacgcgcttccgcgaccaaagggaaagtctcgctatgacaccgcaacatagacgcaccatgtatggcatcaatatcggcatcgcgttggcgggtattgggaatttcatctattttccgcacctcgtcgccaccttgggatcaagctacagcgggttctgggccggcttcgtcatgttcatgacctatgtcggccgtttgagcgccaccttcagctatgagggattttcggcgcgggtcggcaagcgccacggcatcgtcatcggcatcctggtggaggcggtggccctgggcctgatggctttcgcgcatgacgtcgtcgcctatagcgcgctggccttcttcgtgggcttcggctcgggcacctccttccccgggctgaagaacgtgctgggcgaatttccggaagcggctcgggccaaggcgttttccagcttccagctggcatcccagtccggcatcatcctcggcgccctggctggcggcctgttcagcaatgcccagatgccgctggtgttcctggtggtgttcctgctgttcatcggctactgcatcgccgcgtacttcgtgattccgggcgagacccatccgcccaagcgcgacgtgccgctgttcaacgccggcatcttgaaagggctggagttgggagaggggaccttctacttcctgttgtccagcttgttctggctgctgtctctcaacttcgtcgtctccatgcccttgcatatgcaggcttatgtcaaggagctgccgctgacggttccgttctggatcaccggcgtggcgatgctgttgctgcagatgccgatcttccgtttcttcaacggccgtttcccgcctggctacgtgatggcgattgccttcatcggcatgagcgccgcctatctgatgttcgggatgggcgtctccgcctattgggtggtggcgggctgcctgatcgtgatcctgggcgacatcctgttcacgccttcgtttgatatgtgggtttcggccaagatcccggccgatcggctatcccgcgcgatgggcgcgatgcacttcttccgcagcctaggcaacatgctgggttcgttcctggccggcttgctgttcgacctgtcgcgccatatgggacgcccgggcctgaactggctgattgtcgccggcctggccttgttgtgcgcggtggtgagcttcgccagcgtcaagaagcgcgtgccgctggccgagcagttgtccggcgccaaataggcaagagcgggctcgcggcgcgcgggcctgcgtaaccgttacggcaaggaaagagacatagaaatgacggaattgaaatccatcaatcagcaacgtccgaccgtcctggtgatttccactggctttcacctctatcgcgaatacctgctgcggcaaatcgtagaggaggcgaatgtctggctgttcaccgatgctgcgccgacctggcagatcccctatctgaacggatacacgctggtgaacacgctggacgccgaggcgatggcgcgggaggcgttggcgctggcggccacgcggaagatcgatggcctgatctgctgggacgagatccggatggtgccgacatcgcgggtcgccgcggcgctgggtctgcctggcggcgaaacggacgcctacgcgcgctgccgcgacaagcatgaaacccgccaggcgttggccgccgccgcggtgccgcagccggagtcggtgctggtggccgacatcgggcaggcggtcgccaccgccgcccgcatcggctatccggtcatcgtgaagccgcgtggcctggggggcagctacggcgtcacgctggtgaacgacgaggcggaattgaccgccgccatgcagcatgtcgaccagcattgcgaactgctggccggcagcggctatacccgctatgaaagcagcgtgctgatcgaggagtacatgactggcgaggaggtcagcgtggacgtagcctgggtggacggccggatgcatcctctgttcgtcgcgcgcaaggaaactggctttttcccccatttcgaagagatcggccacgtgattcacggccacgatcccctgctggaggatgccgaattcctggccgtgctgggaggcgcgcaccgcgcggtgggtttccgcaacggcattacgcacaccgagctgatgctgaccgcgaaagggccgaagatcatcgaaatcaattcgcgtctgggcggcgacatgattccgtatattggtggcatttccagcggcatccgcgccggcgcggtggctgtggcggtggcttgcgggcgcgcaccggatgtggctcggacccgtcaacgcacggccgccgtccgtttcttgtatccggacggcgactgcgtggtccaggcgctggcggtggatcgcgacgcgttgccggagaatgtcgacgacgtgtgcctgctggtggagccgggacataccctgtatttcccgcgcgtctccggtcgttacgctttcctgaccgcctatggcgatagcgaggcggcgtgcaaggcggcgctggatcaggccgccgccgcggtgcgcttcgaagccgagccgttggccgaggcggcggaagcggtgtaagccaggcgccggttcccgccagacgtccggcggggccggctcagcgccagtctgcggcgcctggcggtggagagcgccacgcagcctgcagccgccggccgcctgttccggcatttgttgctggctcagcacgaagcggctatctgcttctttcacccgcgccaagcccttggcggatttctggatgtcgtcatcgatggcggggtccttgtcgaagttcaccgtctcgccgtccacgccggagtggaaagtcttccgctcgcggctggccaccgacccgttccagggggcagccagcgcccggcgcggctgttccgcgtcaaccagctcagcctgttcaaacgcgcgcgctggtagccggcggtaatccttcctttgtgccgcgtcgccggctgcgttaccttcgaaggtcggggcgcgccgtgcggcggcctcgccatgaagacacatgcgaatgctataacggcggaaccggcatccgcccgccgcgggggcggcgttggcaaggcaaggggagacgaatgattaccaccataaaaggcaagatactggccggttccggcctgctgatcctgatcggttttatcgtgctggcaggcgccaacatctacaacagctaccgcaacgccgaaaacgcggtgctggaccacgcccggctgctggccgacagcgaggccggccgcgtgcagcggatgctgggcaagacttacgattcggcgcaggcgatggccgaggcggcgaccggcgtgcgcgccgcgctgccggccaacggccgctcgctgctgtcggaagtggtgaagcggcagctgcccaacaacccggacgccgtcggctactgggtggactgggagccgaacgccttcgacggccgcgacgccgagctggccggcaagccggaaaacgaccataccggccgctacggcgtgtactggttccgcaaggccggcaaggtggacgtggtgtggggcagcgacggcgtcgacgaaagcgcttattacaccgagccgcgcaagaccggcaagccgatgctgaccgagccctatgtcgacccggatgtgaaaatcctgatgggcacgctgtccttcccgctgatcctgaacggcaaggtgctgggggtggccggctgcgacatcgcgctgggccatctgcaggaaatggcggccaaggtcaaaccgtaccaaaacggcttcatgagcctgtattccaacggcggcgtgcagttggcgggccgcgagccggcgctcaacggcaaggccgcgcccgacctgccggccgaagccaaggcggcgatcaaggaaggccggccggccgaatacgaaagcgccgacggctatcgccacttcatcatgccgatcacggtgggcgacgccggcgcgccgtgggcggtgcgcatctccatcccgctggacgaagccttcgccccggtgcgggccgccagctggcagtcggccttcatcagcctgggcatcctggcgctgatcctgctgctgctgggcgccacgctcagccagctgctgcgcccgctgggccggctgcagggcgcgatgaccgagctggcctccggcagcggcgacctcacccgcgaactggccatcgccagccgcgacgaaatcggccaggccgccggcgccttcaacaccttcaccggctctttgcgccacatgatgctggacgtgcgccgccacgccggcgacgtgctcggctcggtgcgccagctgtccggcgaagtggaccagatccgcggcagctccgcccgccaggcggaagccgccaacgccaccgccgccagcgtcgagcagctgtcggtcagcgtcagccacatcgccgaatcggcgcgggtggcagagctgcgcgcgcgcgaagccgacgccctgtccggccaggcggcggccaatgtcgacgccaccgcggcggaaatcggccgcatcgccagcaccgtgcgtcagctggccgatgtgttgggcggcatgcagcagcgctccgaccagatttccggcatcgtgtcggtgatccgcgacatcgccgaccagaccaatctgctggccttgaacgcggcgatcgaggcggcgcgcgccggcgagcagggccgcggcttcgcggtggtggcggacgaagtgcgcaagctggccgagcgcaccgcccaggccacgctggaaatctccggcgtgatccagaccatgcagcgcgacaccgcgcaggcgtccgacagcatgggcggcgcgctgcaacaggtggaccagggcgtgaggctggccggcgaatcgtcgcagtccatccagcagatcagcggccacgcgctgcaggtggtgcagtcggtgggcgacatcgccgcctccaccgccgagcagtccagcgccagccaggaaatcgcccgccacatcgaaaacatccacaccatgctgctgcagaccgacggctccatcgagcaggcgcaacaggccacggtggcgctggcgcggctgggcgaggagctggagtcgctgatcgggcgcttcaagctgtaagccggcaggcggcggaccggcaagagcgaggcgatagaccgcctcgcttttttatcgccgccgcgcggggttcaggcgcgttgcggctatggccgcgcgctgtcgatggtttgccgcaagctgtcgacgaagcgcgccagcgccggattgccggcctcgcgccgccagacgaaacacagcggcagcggcaccgacaggtttcgcagccggtaaaaccgcgcctgcgccggcggccgcgccaggttggcggcgttgacgatggcggcgccgaccccggcgcaaaccagcgccagaatcgccgcctcggtcggctgctcctgcaccacgttcagccggacgccggcttgcaggcaggcgctgaacaggcggtcgtggtattcggggtagacggcgcggggaaaggcgatgaaaggccgcccggccagcgcgcgcaggtcgaacggctgcgtctcgtcatgttctatccgccaggcgcgcggcagcgccagcaccacgtcctgctgccgcagcggcagggaggcgaaaccgtccggcagcggctccagctggtagatgaagccgccgtccagcgcatggcgggcgatggcggccagctgttccgggctgttcagcgccgacagttcgacggcgacttccggcgcttccgcctggaaacgctgcagcgcctgcggcaccgggccatcccagccggtgttttccacatagcccagccgcagctgtccggccgcgccgccggcgacgcggcgggcgcgctggccggcggcgtctagcgtcgtcaggatagcgtggacatcgcgcagatagctgtcgccggccggcgtcagccgcagcccgcgcggcgagcgcgcgaacagcgcgaaacccagctcgccctccagatcctggatctggcgcgtgatggcgggctggctgatgtgcagtgtctccgatgcggcgcggatgctggcgtgttcggccaccgccgcgaaatagcgcagatgccgcagctccatgctggtgttctcggttttatgatgtttttaagttatcacaaaatcataatacggtattggaatgcattggtagtttccgggatagtagggacatgcctagcgcggacatgccgccaaccgaccagagaaaccagatgaacgcccacacttacaccatcggcaatgcccgcgtgacccgcgtgaccgacaccctgctcaccggcatcaccccggcctatctgtacgccgactggcgcgacgccgcgctggatgagcagccgcagctgcgcgagctgttcgatgccagcggcgagcacatcattctcagcgtgcatacctgggtggtggaactgggcggcaaggtgtatttgatcgacaccggcctgggcaatgacaaggagcggccgttcaacgcgctgttccaccggctgcgcacgccgtttctgcagcggctggccgcgctgggcatccagccggaggatgtcgaccatgtgttgctgacccatctgcacgccgaccacgtgggctggaatacccggctggcggagggccgctgggtgccgacttttccgaatgcccgctacgcgatgccgcagggcgagctggatttcttcgccacgccggaggccgacaagcgccgcgtggtgtttgacgacagcgtggcgccggtgctagccagcggccaggccgtcggcatcgccgcggccggcgccgattacgcagacgccttccattttcacccgacgcccggccactgcgccggccatatgtcgatcacgctgcattcggccggcgcaaccgccatcttcagcggcgacgccatgcactcgccggcgcaggtctaccacccggaatggaactcggccttctgccgggagcaggacggcgcgcgcacctcgcgccgctggctgctggactatgcctgcgaacatcaggccaccgtgttcaccgcccacttcggcgcgtcgtcggccgggcgggtcggccgctcggcaaacgggtatggctggcagttcctgtgaggctggccgcttcgccagcggattcccggccggcgtccgccggcggcgggcttagttgcacttcatcgccagcttgacggtgtctatcaggctggcgcggtcggcgccatcgcgcgcctgcagcgatatgccctgtatcacggtgaaatagaagtttgccaattgcttgcagtccgcgtccgcgggcagctctcccttgcctaccccgtcttccagccggctttgtatcagctggatggtgtgttggcggatttgccgcaaatagtcctgcagcgcgacgttgtccggttcgcaattgaccaggcccaggatcagcaggcagccgttggcccccggggaggccagcaccgtatccacgctggccagcagcatgccatgtatcgcttcggccgttgtcgccgcgctcgccagcgcgcgcatgctggcggagccttccgagtgcagatacagctccaccgcttcgcggaagatggcttctttggagcggaaagccgcgtagaagctgggcggcttgatgttcatcaccttggtcagctccgccagctgggtggcgtcatagcccttggcccaaaagacgcgcatggccgaacgcagcgcctgctcgcggtcgaagctgcgcggtcgtcctctgacgctcatatatttttcctttctttactttccactacataaatagttgacatttagatatttgggcggcatatttcgatttatgtatcagctgctacaaaaattaccagctagcgccatgcttgtctagcaaaggccggatttcgtccgcatgccgcgatgtttttgtcgcgcatctggcgagcagggcgctgcgcggaggtgggagacgggagagggcgcacagccatcttccggcgagatcggttcgttttcacttgaatggggtggcatgaatgaagtggatttcacaagcgctggctagacgcgggcaggggcaatcgactggatggtgggtggggtactgacacgatggctcagctagctgaactgcatatcgagtccgtgctgatcaatacggacaatctggccttgcgtccctggcgtgtcaaagaggtgcatgaattatacgcggcgatacaagacagccgctttcagcagtcgatgctccaggcagaccctttccatcaggccaatgccgcgatggccgccctgaaaagcgcgattgcccacccgcgggcgttgccggtggcggagttcgccatcacccgggtgcgcgacaacacgatagcgggttccgcgctggtcaagctgaccgatgcccgcaccgcggcggtggagatcgattacgccctgtatcccgcttttgccggccagggctatgaggccgaagtgctgggcgcgttggccggctggattctggagtgcggggccgcgcgggtggagctggtgtgcggactgggcgacatccatcgcgccaagaccgcgctggcttgcggcttccgctatgagggcgtgcagcgttgcgccatcgccacgctgcacgggctggagagcggcggcatgttcgccaggctgcccgaagatgccggcacgccattgcggcaggtttttcccgatttgcctcccgaggggctgagcgacggcgtcgtcaccttgcgggtcgcggcggtggccgacgtggaggccttgctggccgaacagaccaatgtcgaggccaggcgctggtcgctgatcgaaccgctgtcgcgctgcgatatcgccagccgggtcgagaaggccgcgctggaatggctggtcgggccgaatgcgtttttcagcattgtcgattgcgaaagcggagaggtggccgggcgcatcgtcctgcgcgcggtggtgccgccgcaggtggcggatgtcggctacggggtgttgccgtcgttccgcggccgccgttttgcctcgcgggcgctgcagctgctgtcgcaatgggcgttcgaacaagcgggctacgtgcggctggagctcggcgtcaaaccgggcaacgtggcgtcgcgggcggtggcggaagccggcggattccgcttcgacggcatgcgcaaatcccggctgcgcaatagcgacggcagcttcagcgacgaattgcatttcgttcgcgtcaatcccgcctatctggaaccggacgtgccgctggtcatcgccagctgagccgcgggcggcatcgcctagtttgcttaccttagatcaagaaagatggaatgtgatgacacaagatcaacttcaagacgcatcgctgagtgaaatgctgacggcaggcggacaaccgttcaaaacctggctggcaggcctggtggcgcaggtcgccggcgacgacaacgtcggcatgtaccggccgcgctcgcggaagggcgtgatccgcccgaatagcgtggagcaggtgcgcgacgtgctgcgcctggcctcgcagagcgaggaatccgtggccctgcatgcgctcagcaccggccggaactgggggctgggctcgcgggaggcggcgcaggacgcctcgctcgcgctggacttgtccggcctgaagcaggtgcgggcgctggatctggatgccggctgggcggtggtggagcccggcgtcacccagggccagctggcggcattgctggcgggaagcccgcgcatgatcaatgtcaccgcctcctccgcccacagcagcgtattgggcaacggcgtggacaggggagtgggcttgcgccgccagcgggtggaagacctggtgggtctggaagtagtgctgcccgatggcgaggtgatgagggtgggttggtggcccgacgccgagcgcccctccccggtgtatccgtacgggcttgggccgtcgccgctgcagctgttctttcaatccaatctgggcgtcgtgacggcggcggtggtgaggctgatgccgcgccccgaggcgctgcgcgtggtgcgcctgagcttcgcccgcgaacggctggccgaggcgatcgatgtgctgcagcgctggagcgcccagggaatggtgcgcggcgtgctcaaggtctacgacgcgaccgccggcgcgctgtatggcggcggcatcggcgaatacctgacccatgtctgcgtggacggcaccgctgccgtggtggaggcgatgaccacggtgatcctcgacgaggcaaaccgttccggcctgttcctgcacgtatcgcattcggatcagcgcgatccgcggctgagcggcaacgtggtggccgagatggtcgccagcgcctacgccggcgatcccagccgcaacgacacgctgctgcaggccacgctggggcaggatgcggaaaatatcgacgccgcgggccgcggctggctgttcttcctgccgctgatccccttccacggcgaagccatcgaccgggcccagcggctgctggcccaggtatacgacgagaccggcgtgcattgcggcgccaccatcaacgcgttgaactccgacgtcatcgactacgtggtcgccatcaagttcgagcgcaacgccgacgaggcgcgccgcgcccaccaggcgctggaccgcctgtaccagctgttctccgccgccggcttcatcccgtatcggctggatgtggatcaccaggactggatagacggcctgagccccgatcaggcggcgcgcgacttcgtgcgcggcatcaaggggatgctggacccgcgcgcggtgatcgcgccgggccgctacgcgtgaactccgccggccagcgccggccatcgaaaacgcattatcgaatttcatttcgcagggagtgactggaatggcttatctggaaaaagaaaacatgggtcaggcggccgccgacgaatggacggcggagcggattctgtcccgcgcccgcgaactggcgccggtgctgcgccagcgcgcggcggaaatcgagcagaaccgccacttgccggcggacgtggtggagctgctgcgcggcaccggcgtgttccgcatggcgatgcccaagtcctggggcgggcccgagctggattcgatgcagcagaccgaggtgatcgaggcgctggccatcggcgacgcctccgccggctggtgcggcatgatcggcgccgactccggcatctactccggctatctgcgcgaggaaaccgcgcgggagatgtttccgcggctggacatgatcaccgccggctggattcacccggaaggccgcgccgagcgcgtggccggcggttaccgggtgaccggcaactggcgcttcggcagcggcagcacccactgcgactggctggcggccggctgcgccgtttatcaggacggcgaacccgtgctggccgagaacggcaagcccgagtggcggatcatgtacgcccgtcccgatgaataccagatccgcgatacctggcataccaccggcctggctggcagcggcagccgcgactacgccgccgtcgatctgttcgtgccggaagagcgttccttctccttccgcgaaccgcgccgcgagggtccgctgcatatcgcgccggacgccatcctgcgcaagatgtccggcgtgccgctgggcgtggcgcgcgcggcgatagaccacgtgcgcgagctggcggcaagccgtttcgaccgggtgacgcagctgccgtggccgcagagctaccgcatccagactgcgctggcccagtccgagatggagctgcacgcggcccgcagcggggtgttcgccagcctggagcggcagtgggaaaagctgtcggccggacagccgctgagcaccggggagcgggtttcggccgcgctggcgcgccaccacgccttcggcaccgcgcgcgccatcgtcgccaggttgttcgacaccgtgggcggcgccgccatataccgcgccagctcgccgctggatcgctggctgcgcgacaccaacaccatgtgccagcacgcggtggcgcaggacatgattttgcagacatgcggcgaattgatgctgggcggccagccggacaatccgttcctgtaagcgagccggcgcgggcggcgctgttccgcccgctctcccattttcttgtttggagcagacctgatgcaagacaacaccgacaacgatctgtcggcgcgacgcgccgacggccccggccacgcctacctgcctgccggcagcggccagcgcgtgtggatgagcggggacgagtaccggattttgctggatgccgcccacagcgccggaaccatgaccttgctggacgcgctggtgccgccggcgggcgggccgccggagcacgcccacgccgatgtcgacgagctgttcgtcgtgctggacggcgagctggagatcatggccgacggcgcgaagtaccaggtggggccgggggggcgcgtgttcgtccggcgcggcacgccgcatgccttccacaaccgcagcgcagacccggtgcggatgctgattttctataccccggcgggcgtggaggagttcttcctggcggccggggtgccggcccaggacggcttgccgccgccgccggcggatgaggaaagcaccgcgcgggcgatcgaggcgggattgcgtttccaggtgtcgcaagcggcgcagcccgcctgagcattgacttgaataaagaaaggtaaagccatgccattggcaatctatgtgttgggtttgagcattttcgccatgaccacgtcggagttcatggtagccgggatgatgccgtcgctggcggcgcagttcggcgtttccctgacggccatcgggtacctggtgtcggctttcgccgccagcatcgtggtgggggggcccatcctgacggtgatgctgctcaaggcgtccaagaagaacaccctgctgacgctggtggcgctgttcttcgtcagccagctgatcggcgccaccgcccacagctatgaagtgatgctggcgtcgcgggtgttgtccggcgtagccgagtcggcgttcttcggcgtctcgctggcggtgtgcgtcgacatcgtcggcccgcagcggatcggccgcgcctcctccatcgtgctgggcgggctgatggtggcgtcggtggtcggcctgcctgcggccacgctgatcgaccagcatctgggctggcgcgccagcttctggatcgtggccgggatgatgctgttctgcgggctggtgatcgcggtgcaggtgcccaaatcgccgaaggccgccgagatcagcctgaagcaggagttcgccgccttccgcaatgccgatctgtgggccgcctacggcaccagcggcctgatcatcggcgccactttcgccgccttcacctactttgcgccgattttcaccgaggtgagcggcttctccaccgctaccgtgccggcgctgttcgcctgctacggcctggccaccatcgtcggcaccatgatcaccggccgcctggccgacaagcacaccatgggcgtgctggccgtcgggctggtgatcctgatctcgctgctggcgctgttcgcgctcaaggccgaatcgcaggcggtgaccatcgtcgcggtggcgctgctgggcttggtcggcctgccgatgaatccggcgatggcgatccgcgtgatgcgcgtcgccaacaacggcccgctggtgaacaccgtgcataccgccgtcatcaatgtcggcatcgtggtgggctcctgggccggcggctcggtgatgagcgccggacacggtctgcgcgcgccgctgtgggtgggggtggcgctggccatcgccggtctggtcagcgtgctgcctttcctgcgccgtcacagcgcggaaggcgtgcgcgcaaggttggcgggcgcgacccgctgaatcgcggcatgcgccgggccgggatgctcccggcgccgggcgccgcatctgaatggaaatgaaagcaatggatacgaaattcgcagggaaggtggcgctggtgacgggagctggcagcggcctggggcgagagctggcgctggaactggcgcgacaaggcgcggcggtggtgctggccggccgcaacgaggacaagctgaaggcggtgcagaacgaaatcgaggcggccggcgcgcaggcgctgtcgcactcgaccgatatttcgctgccgcatgaggtggacgggttgttcgaggcgatacggcgccgctatggccggctcgacatcgcggtcaacaatgcggcgatctgggaaaccggcctggtggccgaacaggacgaggccgcctggcgccgcatcatcgacaccaatctgaacggcacctggcgctgcatgcgggcggagatcggcttgatgcaggaacggggcgaaggggtgatcgtcaatttgtcgtccatcgtcggcggccattttgcgatgcccggcaccgcggcttacggcgccagcaaggccggtatcgaggcgttgacgcgcacggcggccaaggagtgcatccagcagggcatccgcatcaacaccgtcagcccggcggcgctggacaccccgatgtcgctgctggagggcgaaaccgaggaggagcgcggcaagcggctgggcggcatcatccccatcggccgggtgggacgcttgtcagaggtggtgcagaccattttgtggatctgctccggcgatgcctcgttcttcgtcgggcatgactttgtcgtcgatggcggcgtgaccgcctgaccggatgccgccggaacaggccggcggcgagtccggcgcggcgtcggcagcataggcagggagaaagctatggaagtcttgaaaaagcatcacatcgaatgtgacggccaacattggcaacaagagtacaagagcacgctggggcgcttcccgaccggcgtttgcctggcggtgctggaagagggcgacgacaagatcgccatcaccatcaattcgttcagttcggtttcgctggtgccgcccatcatccagttttcgctgaagaaccattcccgcttcctgggcaaggtgcgcgacgccaggcaattcagcgtgtatttcctggcccggccccaggccgaggaggcgctgatgttcgccaagcagccggccagcccggtgtcgccgcaagtgctgggggattccgcggccgccattcactgccggctggaggacacgtatcagaaaggcgaccacaccatggtattcggcgaggtgaaggcggtcgagcatggacgcggcgacgcgcttgcctactaccggtctcatttcacatcggtagagggctacgcatcgtgacgtacttgcaatcgccgaacggcccggcgccgcgcctgccctcgttgaccggcatgcgattcgtcgcggcggcgctggtgtttctgtttcacgcctcgttgctggcagccgtcaaattcaacccttatcaggacagcggcgcggcgcagctgtttcagtccatcttcagcaaggccggctggctgggtgtgtcgttcttcttcgtgctcagcggattcgtgatgacctggtcggcgcgggcggacgactccgccggcggcttcatccggcgccgcctgctgaagatctaccccaaccatttcttcacctggctgctgatgatggtgtgcatggggaatgtgttcgtcgaccccagggtctggctcagcaatctgctgctgctgcagtcgtgggtgccgcgcccggaggtgttcatgggcgtcaacagcccgtcctggtcgctgtgctgcgagctgctgttctacctggccttcccgtggctgaaccagcgcatcgcgcgcattccggccggacggctgtggccgtgcgcggcggcggcggtgctggcgctgttcgcggtgcagctggcggtggacagctgggtgccggccacgcccaaggggccgggcctgccgatttcgctgcagcagtggtggctatcgtattttttcccgccgttgcggatgttcgagtttgtgctgggcatgctgatggcgcgcatcctgcgggccggcaaatggccggatctgggcctgctgcccgcggcgggcttgttgctgggcggttatctgctggcgcgggaagtgccgtttttgtacggactgagcacggccacggtgattccggtggccttgctgatcaccgcggcggcggcggccgacgcgcagcggcgccccaccggcttcaacggccggcgcatggtgtggctgggtgaagtgtcgtttgccttttacatggtgcatatgctggtgctggatctggctagcgcctggctggatggccgccgtttcgagcccgccgcggcgaccctggtggtgctggcggccttcctggccagcctgttggccggctggttgctgtacgcgctggtggagcggccggtgatgcggtactggagccgcccgcgcgccgccgcggtcaggctgcaatcggccgacgcctgagcgggcgacgccgcagaggcggcccgcgccaaatcaatgctaatgaaaattatttagttccggggtgcatatggataagtttttgaagggacgtgtcgcggcgtcgttgctgccgctggccgccgcgctggcattggccggctgcggcaaggatctgggcgcggcgcaagcggcggcgcaggcgccggcgcctgcggtgccggtttcggtgcagcaggtggcgccgggcaatgtcgatgtcgcgtacgagtatgtcggccagtcggccggatcgcgcgaagtggaggtgcgggcccgggtgggcggcatcttgcagaagcggatgttcaccgaggggcagccggtgcggcagggcgatccgctgttccagatcgacccggcgcctttccagatcgcgctggagcaggctgtcgccgcgctgcgcgaccggcaggccgagctgacccgcgcgcagcagaattacgaccgcgtgcagccgctgttccgcgagaacgcgctcagccgcaaggatttcgacgaggcggccgccaatcgggaagccgcccgcgcccaggtgatggcggcgcaagccaaggtgaaggaggcgcagatcaacctgggctatacccgggtgtcggcgccgatttccggcctgaccagccgcgaggtccgctccgagggcagcctggtgggcggcagcgccgacgccagcatgctgaccaagatcagccagaacgatccgatctatgtcaatttcaacgtgccggaggcggatctggacgcgctgcgcggccagcagtcgtccggcgcgctgaaattccacggcggcggcttcaaggtgtcgctgcggctgtccgatggcagccgtttcgaacgcagcggctcgctcaacttcaccgaccacctggtggacgcctccaccggcaccgtgcgcctgcgcgccagcctggccaatccggacggacggattctgccggggcagttcgtgacggtgctgctgcaaggcgcttaccgcgcccaggccatcgccattccgcaacgggcggtgctgaccagccagcaaggcaaggcggtctgggtggtgggcgcggacaaccgggtgcagctccgcccggtggaggccggacaggaacagggcctcaatgtgctgatcaacaaggggctgaaggccggcgaccgggtggcgctggacaatctggtgaagctcaggcccggcgcgctggtgcagatcagccctgagccggccgcaaccggcgcgtcttcccgcagctaatactggagcctcgcaatatgttttcctcctttttgatccgccgaccgatcttcgcctgcgtgctctcgctgatcatcatgctggcgggggtggcggcgatgggcgtgctgccggtcgagcagtacccgcagatcgtgccgccgcaagtacaggtggtggcaagctatcccggtgcctcggccgaggtgatcgccaataccgtggccgcgccgcttgagcaggcgatcaacggcgtcgacgacatgctgtacgtgcagtccatcagcgccagcaacggccagttgacgctgaacgccacgttcaagatcggcaccagtccggaccaggccaccatcaacgtcaacaaccgcgtgcagtcggcgctggcgcagctgccggaagaggtacggcgccagggcgtatcggtgcgcaagcagtctgcggcgttcctgcaggtgatcgcgctgtacgcggagaaggggcgctacgacaccctgtacatgagcaactacgcgctgctcaacgtggtggacgaactcaagcgcattcccggcgtaggcgacgtgatcaacttcgccggccgcgactattcgatgcggatctggctcaagcccgatcgtctggcgcagttgaagctgacgcccagcgacgtggtcgccgccatccgcgagcagaacgcgcagttcgccgccggcaagctgggcgccgaggatcgtagacgctgacgctgccggccatgtggccgccgccgtgcaggaaaaccagcaccggcagcggccggcgcggttccgggtggtagatgcgcaccggcacgcggtattcgccgcccggggccagatcgtcgttgacccaggcgatggcggggccggcggcgacttgctggcgggtcaattcggccagcgcttcgcgcgcgccgatggcggtggccttgtagcccgcgtccgccttctgcttgagggcgaggttgtattcggccagccagggctgcagattggggtggagggggtgcatggtcggctcctgcgcgcggtcgcgtggcgcgagatatcctcaatctataccactgacatttaaacggcaattttgatgacctgtttccaggtcacggggtcaaccgaacaacaagtccagcaagccgggcttgctgcgggcgcgcaatgggccgctgccctgcagcaggctgtctatcaggccgctgtcggcgcgcggctgccgggccttgaccgggtcgcggttgcccgacggggcgagcgatagctggccgttgccgcggcgcagccggtagccgccggcgcagctgggacagaagatctcgtcgccatcggccgcgctgccgggcaccgcgatgatggggccgcaggccaggcagctctgcatcggaatgcccggctcgctgtggcccagcaccccgtccagccggccgctgcgccccagctggatgaagcggctgcccaattcctggtcgaactggcggcccaggttttcttccaggatggccagcgcttttggcagcggcatgccctggcggtaggggcgggtgctggtcatcgcgtcgaaggcgtcggtgatgcctacgatgcgcgccaccagcgggatggccttgccggccagccgctgcgggtagccgttgccgtcgggggtttcgtggtggcatagcaccgcgtccatcaccagttcggccaacgggtggtcgcgcagcagatcggcgccgacgcgcggatgggtcttgatcacctcgtattcctcgtcgctgagccggtccggcttgttcagcaccgcgtccggcacgcctatcttgcccaggtcgtgcaggaaaccgcccagcgcgatgcgttccacttccggctgcggcagatgcaggtcttcggccagcagatggctgtagcgcgacacgcgccacaggtggccgccggtgtaggcgtcgcgggcttcgaccagcatggccatcgtatacagggttttcagcagttcgcggctggcttgcatggcgtcctcactagcgggtggcgggcagtttcaatatggcatacgggggtaaaacgcgcggcggcggcatccgcgtgctgcgctggcgataaggcgacaataaatcgagcgtttaatctaatttttaccgcaacgtcatgattcgccatatacaaaattcatattctcttcttaatgtagctgctgcgtgtcattagtcggacgcgcggccgttccattacacctacacggaggagaacgcatgaaatcgtggttgctgctgggtttgaccctgtcttcgctggctgtcgccggcaatgaacctgttcagccggatgcccgctacggccgcatcctgtcgccgtccggcccgctcagccgcgccgagctgctcaagcaaggcctgcccaaggccaagccggcggccgctcgcctcagcgccgccgcggtgcccggtccggccacctacacctatctgcgctgctactaccgcaccggcgccggcaatacccagccgaccaccgactacgtctgggcgctggatccctccagcggcgattactaccggctgaacggccactggtggtccagcagcatcctggactggaagaacatgttctacagcgacgcgacgcaggacgcgctgcgttcggtctgccagggcacgctggccaagaagggcatcaaccaggcgccggcgatggtgttcgccgccgacaacgccatgtccttcaactacacggtgtggagcaatgaccaggccgggcagggcagccgcatcaacaagatcatcgccttcggcgatagcctgtccgacaaccagaacgtctataacgcctcgcagtggacgctgcccaaccgcaacagctggttcatcggccacttcagcaacggcccggtgtgggtggagtacctggcgtcgcggctgcagctgccgctgtacaactgggcgataggcggcgcgggcgtgaccacgcagaagctggtgattccgggcgtggtgcagcaggtgcagtcctggcagcagtacatgcagcaggcgcccaactacaatccggccaccacgctgttcaccatgtggataggcggcaacgatctggtcaactacggcagcacgccggacaaggtgatcgccggccagcagcaggcgctgacgaatctgatcggctccggcgcccgcaacatcctgctgctgaagctgcccgacgtgtcgcgcgcgccggtgttccagctgaagagcggcggcgccacggtggcggcgcaggtgctggactacaaccagaagctggacgcgctggccgtttcgctgcgccagcagtacggcgtcaatatccaggtgttcgacagctacgcgctgttcggcgatctgctgaccaatccggccaagtaccaggtgagcaacaccacccagtcctgcctcaacatcaacaccgattcgtcgctgaactacatgcaaagccagtcgccgcgcgccaactgcggcaatgccgacaccttcgtgttttgggacacgctgcatccgaccacccatacccatctgctgctgggcaatgcggtggccgacttcctgaacgcgtccggcagcgccttcccggcgctgaagacgctgcgctaagggcatgaagcgggcggcgcgcttggtgcgccgcccgccagggcttacaatccgggttttaccggccgcggcgcatgccgcggcccggcctggaaccgaaccgaaagtccccatgtccaccctgaccgaactcctcagccgcgccgccgcggcgcgcgccgaattgatagagcgcctggccgccgaagacaccaactgctaccggctgttccacggcagcgtggaaggcgcgtccggcctgaccgtagaccgctacggcgagcagatcctggtgcagagcttccaccagccgctgagcgaggaagagctggccgagatccgcgcttactaccggcaaacgctgccggagctggcgctggtctacaacgaccgcagcgaatcccattcccgcatccgcaacgcgctgccgctggccgaacaggcggtagccgaacaggacgtcgccatccgcgagaacggcgtggccttccattaccaggcgcgccacaagggccaggacccctggctattcctcgacctgcgcgccgcgcgccgccgcgtgatgcagctggctgaaggcaagagcgtgctcaacctgttctcctacacctgcggcgtcggcgtggcggcggccaaggccggcgccagcttcgtgctgaacgtcgatttcgccgaatccagcctcagcgtcggccgcgccaacgccaagctgaacctgctggccacccggccgcgctgcctgcacagcgacgtgttcgccgcgctgcgccagctgtcgggcctgggccaggcggagcgggtgcgcggcaagaagatgccgcccttccccaagctggaggcgcgccagttcgacctggtgttcctcgacccgccgcgctactccaagagcccgttcggcgtggtggacctggtcaacgactatcaggcgctgttcaagcccgccttgctggccaccgcggccggcggcgcgctgatttgttgcaataatgttgcagaagtgaatggcgaaacctggctggaagccttgaagcgcagcgcggcgaaagccggccgcgaggtgcgtgcggcggagtggatcgctcccgacgccgactttcccagcgccgacggcaaacccccgctgaagatagtcctgctgcacgtttgagacgcattctcatttgttgcgagctgaaaaagccgccctatgccagggcggctttttctcggtttgatccaggacaatttgcgattaaatcagttaatttgtttaaaattaacgttttattttaaatatatttgcttggtatgatgtttgacacggggccccgcacctgcccggacggcatgtcggcgcaggcggcgagagagctatcccgttgataaaaaaacaaggtaccgggtgaatacatgaaaacaagcatcattttgtccctgctgttgggcgcgctggcttccggccaggcgctggcgcaggcggagcagccgcccagcgacgagctggacggcgtcgtctccgccggcaaaccgttgtcgggcagcgaggcgcgcgccgcggccggccaggccaagccgcagccgggcagcgccacctacacgtatctgcgctgctattaccgcaagagtccggtggccaaccagccgcagaccgactacgtgtgggccaccgatccgtccagcggcgactactaccgcgtcaacggctactggtggtcgggcagcttcgtcgcgctgaagaacatgttctacagcgataccagccaggacacgctgcgttcggtgtgccagcagacgctggccaagcagggcgtcaaccgtccgctggcgttgttcgccgccgccaacaacgtgatgtcgtacaaccacaccatctggacgctggacagcgcgagccaaggcaacgcgatcaaccgcatggtggtgttcggcgacagcctgtccgacacccagaacatgtacggcgcctcgcaatggcggctgccggtggccagcagctggtacgtcggccgcttcagcaacggccgggtgtgggtcgagcatctggccgaccagctgaagctgccgttttacaactgggcgataggcggttccgccgccgacagccatctggtggtgccgggcctgttgcagcaggtggactcctgggcccagtacatgcagaaggcgccgggctaccgtccggaaaacacgctgttcaccatgctgatcggcggcaacgacctgctcaactacggccgcgccgtcgatcaggtgatcgccgaccagggcaaggcgctggacaagatcatcgccgccggcggccgcaacatcgtggtgctgacgctgcccgacctgtcgcgcacgccgtccggctcggccggcggcaaggcggcgcagctggcgcagcaggtgaaggactacaacgccaagctggcgacgctggtggccaatctgaagcagaagcacggcacggcgctcaagctcagcctgttcgacgcttacggcatgttcaacgacctgctgacgaatccggccaagtaccaggtgagcaacaccacccagccctgcctgaacgtggcggccaacgccagcctgccctacatttcgtcgcagacgccgcggccggagtgcgcgaatgccgacgcctacgtgttctgggacaatctgcacccgaccacgcacacccatgtgctgttgggccagatggtggccgacttcctgcgccagcagaatctgaacctgtcggcgcaggcgcgcaagcgctgatccgcccagtttgggaaacacccgccaaccgcatgccttgccggcatgcggttttttgtcgccgccgtttcgcggatgagggcgggttccctctgcattcgaatgccgcgcggccggggtcagagcccgagctggaaccgcagcgccaggtaggcggcggagacggccaggctggccagggtgatcggcacgccgacgcgggcgtggcgtttccagtcgatggcgatgccgcgcctggcggcggcatcgacgacgatgatgttggcgatgctgcccacaatcagcagattgcccgacagcgtgctgaccagcgccaacagcaggccgctcgtctcgtgatgggcgaccggcaacagcagcatcaccgccgggacgttggagacgatgttggacagcaggaaggtggcggcgaacaaggggccgggctgctccagccgcacgccgagcgcggccaggccggcgacggcgtccgcggggatcccggtgcgctgcagcgcatggttgacgacgaacaggctcatgaacagaaccagcagctcccagtcgaccagccccagcatcttgcgggaatgcagctggcggctcatcagcaggatgcccgcgccgatgagcgccatgtgctccttgggccacggcgccgccaggaaggccgccagcagcgtcgcggcgatggcgaggcctttcgcggtttgccagccatcgaaaggcgtgtcttcgcgtggcggctcggcggcggcctcggcggggccggcatccagccagcggccgccggtctgtcggatgatcagcccccaacatgccagcagcccgaatcccaccggaatggcggcggccaggacatagccgccgaagtccaggcgcagcgtctggccgatcagcatgttttgcggattgccgatcagcgtcgcggccgagccgatgttggatgcgcaggccagcgccagcagaaacggcaccgggtccagccggcgccgccggcaggcgtcgatcaacaccggggcgacggccaggcagacgatgtcgttgctgaacaccgccgacagcgccgcgctgacgacggtcagcgccgccaagagtccggcggggccgagcgacagggtcgccaatttgcgggtcacccagtcgtagaagccgccgaggcgcatctgcgccgatatcaccatgaaggcgaacagcaatatcagcgtgggcagatgcatggctgccaccgcttgctcgaggctcagcgcgttgacgccgatcagcgcgatcgcgccgagcagcgcgacgccggtgcggtcaagctgcaggaacggcagtccgccgagaatcatgccgagatagacggtgagaaagatggcgaggatggtcgtggtcatgtggtaagcgccggcgcgcatcggccagtctgggagagggccgagcttggggacgagggagatggctgtttcatggcggccggaaggcggttgcgcgggcacggcgttgccggcgcgcgcggcatgcgttcttggcggaggctactggttggcccgcacccagcggtgccactggccgaacagctccggggtgatggcggcgatcaccgagcgcttccagatcacgtcgctccagtagtcgtcgctgttcaggctggcgatgcggccgccggcctcttccaggatcaccgcgccggcggcgtagtcccacagccgttggccgccgtgcaggtagaggtcgtagcggccggcggcgaggaaacaccagtccagcgtgctggatcccatattgcgctggctgccgcacggcgccaggctgcccaggcgggcggccagcttgccggagcgcaggtatttcacctcgacgctggcgatggcgtcgccgatgcagttgtggatggtcttcagcggcaggctgcggccgttcatccaggcgccctggccgcggcgggcgtagaacatctcgtccgacaccgggttgtagatcacgcccagctcgctcttgccgttcaccatcaatcccaccgagatggcgaaatagggcaggccgttgacgaagttggtggtgccgtctatcgggtccaccacccacaggccgtcctggttgccgtcccatagcgcgtcctgctcttcgcggtccatttcctcgcccagcaccggatgcggcaagatttccggcaggccgcgctgcagggcggcctggcaggcgaggtcggcttcggtgaacagggtgccgtcttccttgcggcttttgccaacgtgcaaaaagcgcggcatcacctcgcgggcggccacttcgcgcaccagtcgcattacctgttcaagcacctgcatcctgtttctcctgctggtttgcgtcgtcgcggcgcaaaagcggtttgccgaatggagcaaacctagcaaaataccggtatcaacagcgactttcaatatccgatgccaaggttttatctcgatgccgatcttcaggtcggccagcagctgtccctgcccgatgctgtggtgcgtcatgtacaagtattgcggctgaacgccggcgacgccatcaccttgttcaacggccgcggcggcgagtaccaggcctgcctcagcgcggtgcagaaacgcgacgcccagtgcgtggtggagcgcttcgacgaggtttcacgtgaaacgccgttgtggctgggcctggcccagggcatttccagcggcgacaagatggagttcacgctgcagaagggcgtggagatgggggtgtcggtgttccagcccatcgccgccggccgctcggtggtgaagctgtccggcgagcgcgccgacaagcgggtggcgcgctggcaggaaatcgtcgtctccgcctgcgagcagagcgggcgcaacctgattccgcaggtactgcccatcctgacgctgaacgaatggctgcaggcccgccaggaggccgacatccggctgatcctgtcgccgcgcggcgacaagagcttggccgaattgtcggcccggccggcgcgcagctggctgatggtcgggccggagggcgggttttccgcgccggaggaggacgcggcgctggccgccggctggacgccgctgaagctggggccgcgcatcctgcgcaccgaaaccgccgcgctggcggcggtggcggcgatgcaggcggtgtggggggattacagctagggcgcgtcgccccgttggggtgacgcaccctacaggaagcgcagcgggtctatcttccatttctccggcgattcgtgcttgacgatgcggtcgccgccgccgtggcccatccggcgcgacaggtccaccacctctggcgggatgtgggcattgctcttgatgctgaagaacaccttcaccttgggcgagatcaggctgctgtcgttctgctccaccaccacgcccagccggccgctttccagccgcaccagggtgccgaccgggtagatgcctatcacccgcatgaaggcctgcaccagctccgggttgaagtggaacttcgaccattcatagatcttgcgcagcgcgtcggtgggcggcatgccctggtggtagcagcggttggaggtcagcgcgtcgtagacgtcgacgatggccgccatctggcccagttgggagatttcatcgcccttcagcccggccgggtagccgctgccgtcgtggcgctcgtgatgctggccggccaccagcaccgcggtttcggaaatgccctgggtggcgtgcaggattttctggctttccaccacgtggcacttcatcacctggaattcctgctcggtcagtttgcctggcttgttgaggatttcgtccggcacccgcatcttgccgatatcgtgcagcatgccgccgatgccggcgtggtgtatcacgtccttgcccatgttcagcgcgttgcagaagctgaccatcagcgcgccgacgctgaccgagtgctggaaggtgtagttatccttgtccttgatccggcacagcgacagcagcgcgccgttgttgcgcaggatggattcggtcagcctctccacctgcggctccacctgttccagctccacctgtttgcccaggcggacgtcttgcaggatgtcgcggacgatctggttggcttcgtggtggatgacctgggcgcggccgaactcctcgccgctttccaccttgcgcaccaccgtgctctcgcgcgaggcgatggcgcgcaattcgctttccagctgcttgcgcacttcgacggcagaaggcgccgatggcaggtctatgcctttgcgggtgtcgatgtagacttcatggatgccggcttcggcgattttctggatctcgctctcgtgggcgaccttgaaacggttgaccagaaacgggtgggacatccagtcgcagttgaggtcgtggatgtacatgccgaccctgaggtcgttgacgtctatgcacttgatcatcgcgtatttcgggaaagccggttgggcgggatggatcgggcccaaggccggaagcggtggaaccacgccggtgttcttcaagcatcagccgggatggcgggattttcaaggcccgatcgcaggcagggtcaaatcggccgcgccgcgatcggaacggatatttcgccgccgtccatcgcggccggcttgcccacaaggggcggatcgggatatattcccgcagttttgttcggaacacggtaatgagccaggcagcacgacagcgcgatcgcagcagcggcacccgcaggggtggcgtggcggcgttgccgttcggagcagccgttcccgacacgcccgtattcccgaaaaaaagcccctgacgcaggggcttttttttcgtccgtcaccagcctgccaacatgaggaaagcgaccatggccaatccactgtaccggaaacacatcatctccatccccgacttcagccgcgaagaactggagctggtggtggataccgccgctcgcctcaaacagaacccgcgcggcgacctgctgcaggacaagctggtggcgagctgcttcttcgagccgtccacccgcacccggctgtcgttcgagaccgcggtgcagcggctgggcggcaatatcatcggcttcgccgatggcggcaataccagcgccaagaagggagagacgctggccgattcgatcaagatcatcagctcctacaccgacgcggtggtgatgcgccaccccaaggaaggcgcggcgcggctggccagcgagttctcggcggtgccggtgatcaacggcggcgacggctccaaccagcacccgacgcagacgctgctcgacctgttcaccatccgcgaaacccagggccggctggagggcttgtcggtggctttcgccggcgacctcaaatacggccgcaccgtgcactcgctggcgcaggcgctgtcgctgttcggcgcgcgcttctatttcgtggcgccggaagcgctggcgatgccggactacatctgcgaggagctggatgagcgcggcatcgaatacacggtggtggacagcctggaagcggtgattccggaagtggacatcctgtacatgacccgggtgcagcgcgagcgcttcgacgaagccgaattcaagaagatcagcggcaagttcgcgctgcgcgccgacatgctgaaaaacgcccgccccggcatgaaggtgctgcacccgctgccgcgggtggatgaaatcgcagtggatgtggacgccacgccgcacgcctactatttcgagcaggccaagaacggcgtgttcgcgcgccaggccctgttgtcgctggtactgaacgaaaccgtgtaatcaggcaaggaaggacaagatcatgcaatacacccgcaccgtagaagcgttgaagcaaggcaccgtgatcgatcacattccggccggccagggcgtgaagatcctgcgcctgttcaagctcaccgaaaccggcgagcgcgtcaccgtcggcctcaacctggtcagccgccacatgggcagcaaggacatcatcaaggtggagaacgtggcgctgaccgaggaacaggccaatgagctggcgctgttcgcaccaaaggcgacagtgaacgtcatcgacaacttcgaagtggtaaaaaagcataaattgacactgcctgacgcagtggagggcattttctcctgccctaattccaattgcatttcgcataatgagccagtgacgagctttttctacgtaaaaaccctggcacatgacacaaaaatgaagtgcaagtattgcgaaaaggtgttcagtagggatattgttgcagaggtgcgctgagtcgtacaaagggtgagaatagagataatcaagaaaaacactgcgttcgacagtggcagtaaaacggagaggcgccgcaggagactgcggcgcttttcattttccgcgaagccggcctctgctaggcttggctgatatgcaccgccgccgctccgcgctaaacccccgaccatgccttcctccttgctcaagcgccatcccgccgtcctcaatctgctgctggccgcctgttgcggcgtgctgggcgcgctgctggtgttgtgtttccagggcgttctgcacgccatcgaaaatctgctgtccggccagagcggcagcctggtcggcatcgcccgccagttgccgccatggcagcgggcgctggcgccggtcttgggcggcctgctggccggcgtggtgctggagcaggggaggcatctgctgcgcggctccgccagcggcgactacctggaggcggtgcgggtcggcgatggccggctgggcctgcgccgcacgctggtgaacagcctgtcctcattgtgcacggtggcgtccggcggttccatcggccgcgaaggggcgatggtggcgctgtcggcccagggcggttcgctgctgagccggctggtgccgatgaccttgccgtcgcggcgcctgttggcggcgtgcggcatcgccgccggttgggcggccgcctaccacgcgccgttgtcggcggtggttttcgtcgcggaagtggtgtggcggcggctggattggcgcgcgctgccggcgctgctgctggcggcattgaccgccagcctcacggtagaccacctgttcggcctcgcgccgctgtaccgcaccgcgccgctgccggcgccggatcacctggccttgttcggttactgcctgctggcgctgccgctcggggccggctcgccgctgtttctcaagtcgatggaattgggccgggcggccttcgcccggctgcccttgcgcctgccgctgcggatggcgctgggcggcgcggtggtgggggcgctggcctggttttggccgcagatgtggggcaacggctacagcacggtgtcctggctgctgcaggccgaatcggcttggcagctggttttggtgctgctgttgtgcaagctgtgcgccaccgccgccaccagcggctccggcgccgtcggcggcattttcacgcccatgctgttcgccggggcggccggcggggcgctggccggccagttgctgaatctggtgctgccgggctggctgccggcgggaggggcggtgctggtgggcatggcggcgttcctggcggccaccgcgcaggcgccgctattggccgtgctgatgatgatggagctgaccgccgcctggcacatgctgctgccggtgacgctggcggcgctggtggcggcgcggctaggccgccgcctgggcggccgcgcgctgtaccaggacgagggcgggctcaggcgccgctagccgggccgctgctggcgtcgtcgtcgatgaagcgctgcagatagaccaggtccagccagcggccgaacttgaagcccacttgcggcaggcgtcccacctgcacgaagcccagtttctcgtggaagcggatcgagccttcattgtcggcgtccaccgcgcccaggatggtgtgcttgcctagcgcccgggcgcgcggcagcagcgcctgcaccagcgcggtgccgatgcccttgccgcgggcgtcggcggtcaggtgcacgctgtgctcgacggtgaagcggtagccggggcgggcgcggaaatcgccgaagctggagaagcccagcgcgcggccggcgtcgtcttcggccagcagcaccggatagccggcggcggcgcgatcctggaaccacaccgcgaattcgcccggcgtcagcgggtcgtcgttgtagacggcggtggtggtggcgatcacttcgttgtaaatgtctagtatcgcggccaggtcttccaggttggcttcacgaatctgcatgatctgtccttgcttgaggtcgtaggggccttgatccaaggcttgagcaattaacctaccagttttcaaccggagacggcgggtttcttgcgcgggctgcgcttcttgcgcgccggcgcggccgattcttccacggcggcctcggcgggcggcgcttcctgcagcgcgggctcgctgtcgtggcgcaggcggatctcgctgtgcagcttggagccgttgcggttctcctgcaccgacaggaagtccagcttcttcaccatttgcgacagccggctgtggccccagttgcgcgggtcgaacgaggggtcgttcttggccaggtaggagccgacggcggacagttcggcccagccgctgtcgcgcgacaccgcttctatcgccgaggtgaacatgtcctgcagcgggtggcgctctttcgcaggggctggcttggcgcgcgaacgcgaggcgcgggtcttgggcttgtcggccggggcttccggcttggccttggccggcgcgggcggccgcaggatttcggtgaagacgaatttgtcgcaggcggcgatgaaggggcgcggggttttcgattgctcgcccaggccgatcaccatcagcccggcctcgcgcaggcgggtggccaggcgggtgaagtcgctgtcggaggataccaggcagaagccgtcgaaattgccggtgtagagcaggtccatcgcgtcgatgatcagcgccgagtcggtggagttcttgcccttggtgtaggcgaactgctggatcggcgagatcgcgtattggtgcagcacttccttccagcccttgagctgggtggtggtccagtcgccgtaggcgcgcttgaccaccgcggtgccgtacttggccacttcggccagcagttcggcgatcagcgccgactgggcgttgtcggcgtctatcagtaccgccagtttgcggttttccattgggtctttcgtgatgggcgacagcacatgctaagccgggctttccggcgctgtcaaaaggatggcggcgcgctctgggcgcgggcggcgtccagcgcgcggctgatgatgcggtcgatctggccgctgcgcttcatgtcgctgagcgcctggttgagctgccgcagaaactcctgcttgtaggggaagcggccctggtcgcggtcggtgaagccgacatagccttgctcttcggacacattggccgtcagcagcaaggcgccgggggcgtagagtccctgctgctgcaggcgcgccagctccagctgtatcgccagcttgtcgttcagatagcaatccaggtggccgcggatgaccttgagcagattggtgcgcacgtcggccgcctcctccagcgcgatctgcccctggcccaccatgccccagaacgcgtcgccgccggggcggaagccggcgttgttgccgaaacgcaggccgcggtagtcgtcgggccagcgtttgcgcggcggctgcgcgaccgccgcccggcaataggccaccacctgctcgctcagcatcggcaccgagtatggctgcatgtacggccgttcgcgcggccggtagtagggcggcgacagcgccagcgccttgccgttttccagttcggccagtccgcgtttccacggcaccggcttcagttcgatctggaagccgcgcagctggctggaggcggcgcgcagaatgtcgttgtagatgccttgcgcctggccggcggcttcgtaggaatagggcgggtagccgttgtcggtcaggatggtgacggtctggacatcagccgccgcccaggccggacacagcaggagcaggaggtggcaagcgtggggcagccgcatggcgtgatggcgggcgaggatggcgatacacctgttatagccgctggcgcggccggatggtggcacggctcttgcgtgttggctgacgggatgacggccgagggaaaatcatgcaaccgcaagcgacggcgtcgggaaaaaccggcgagatggtgatgttcaattaccgccggccggtgcgggcgcgccaggtggaactgcagggcggcagccggctgtggctggtggagatgctggaccggcaaagccaggtctgggtgtggcaggacgagtggccgggcgccgacgccgcgctggagcgcgcgcgccggctcagcctgatgctggattagcttatttcttggtcagggtcttgccgtaggcttcggcggcggcctgcattttgggcagcagcgccttttccgcgctcttcagcgtgtcgccggcgatgctgttgatgacctgcggctgctgcttcagcattttttggccggcgggggtcttgtagaaggcgttgatctgtttcagctcgtcggcgctgaactgggcgctgaagttcttcgccacggtctgctcgaactgggccttgaccgcggcggagccgaagtaatcggtggccagcttgtggatgttgtcgccatagcccttcaggccggcctgcgcctttttctgctgggcttcggtcagctggatcttgttcttgaccaggtattcctgcagcagcggcagcgcgctggcggtggtgcgctgcgccaggtcgggcagcatgttgttgatgttgagcgtggcggccagttccttggctccggcatcctgggcggcgtcggcatgcgccagcagcggcagggtaagcagcagggcggcgaggctggccttgagcgagcgggaagcaaacatggcaaatcctttgatctggtgaaagatgtcggatcggcagtgtgacaccccgcaccgctcaggtcaaagcggcctggccggtttctcagcgcggcgccggcggcatgcggcggctttgccagccctgatagccggctagattggcgcgggtgaccaggccgaccggcactgtcaccagccgcttgccggcatcgccctggcgcaggcgcagccccagcagcacggcttcgcggccgatcagatacggcgactggctggcggaggcgacgatctggccgggcaggcggagcgcgcgctcgatgtcgggcgagccgtccaccgagccgatcagcacctgctggcggccggcggcgcgcagcgccttctcggcgcccagcgcctggcggtcgttgatggtgaacaccgcgtcgatgcgcggcagccgctgcagatcgcgctgcatcgcgcgctggccgcccaggctggagcccatggcgttggcgcggtcgttgtcgacggcgatgccggggtaggcggccagcgccgcgtggcagccggcgatgcggtcgctgaccgaagtgacgggcggcccgccctggatcaacagcgtgcccttgccctgcagccgctgcgccagatagcggcaggtaatctcgccggcctggcggttgtccgacttcaccgtgccgtccacgccgggggcgtcgacgtccaccgccaccaccgtgatgccggcggcgcgggcctggcgcacctgcggcgcgatcgcctggctgtccaccgcgcccagcaggatcaggtcgactttctgttgtatcagcagccgcatctggcgctgctgctgctccagggtgaaattcgcagacatcgaggtgacgcgcaccgccgcgttcaggccgtgggcggcttgcaccgcgccgcgcgccaaggcctgatagaaggggttgtccagcgcgccgaccgagatgccgatccgggcgagcgcggcggcctggcaagatgggccgcacagcagcaggaggccgcaaagcagggtggagcgggctgcgggcatggcttggcgaggggcggcggaaatgcttcagtctagaccatcgccgcctccggcgcggcggtgtccgattccagccggctgagcgcgcgctcggccaattgccgcagcagcggccagccttcttcccattgctggtggccggaatcgacattgatgtggccggcgtgctgcagccaggtgatgggcgcctgccagtagccggccagccgggcggcgcgcgcggtcttgcagaaggggtcgttgctgctggcgactatcctggccggaaagggcagcggccggcgcggcagtggcgcgaaattcatcagttccgccggcacgaagggccgctcgacgtcggccggcgccaccagcaacgcgccggcgatgcggccggggtggcgctgcgcgtagtgcgccaccgtgacgcagcccaggctgtgggcgatcaccagcggcggccggcggcagcgcgacagcgcggcgtccagcccatccagccagtcttccagctgcggctgggcccagtcggcgttgtccacccggcgcgcgcccagccggcgctgccagtggctttgccagtggcgcgggccggagttgttccagccgggctggatgatgaggtcgaacggctgcagcgtggcgagcatggcgggcttccgctagagaggatggcctgactgtagcgcggccgcggctgcattaaaaataatatggaatggttttgatattctgctgaattataaaagcggccggcggctcatcccgcttcgcgctcgcgccagttcagccacagccgcaggtcgaactccagctggtggtagtcgggcagcatgtggcagcacaactggtagaaggcccggtcgtggtcgcgctccttcaggtgggccagctcgtgcaccgctatcatctgcaggaaaggcagcggcagctcgcggaacagcgcggcgatgcggatttcgctcttgcttttgagtttgccgccctgcacccgcgacaccagggtgttggtgcccagcgtgcccttcagcggatgctggcggttgtcgtacagcaccttggccggcagcggggcgtttttcaggtagcgctgcttgatggccgcgacgaactggtacagcgccttgtcggtctgcacctcgttggcgtcgggatatttgcgttgcagccacgcgcccagctggccggaatccagcagcgcctgcgcctgctgcaccagggcgggcgggtagttcagcaggtatttgagcgctggcatcggggcgcggttatttcagccgctgcggttccagcagcacggtgtgctgctcgtcggccagccacatctggccgtcctggatggtgacgttcagctgcatgctgcgctgggcgaggccggccagcgtctgcagcgcgtcgaaatcgatgcggaacacttccagcttgtccagccgcgacagcttgttttcgatctggctccaccagacttcgctagcgcggccgccgtaggtgtacagcaccaccttgtcggcgcggctgcaggcttttttcaggcgtttttcgtccggctcgcccagctccacccacagttcgatttcgtcggaatagttcttctgccacagttccggctcatcgtcggcgctgaggccgcgggtgaagctcagcgtctcgctggcgttgagcgcgaaggcggcgacgcgcagcatcatccgctccagggtttccgagggatgctgcgccagggtcagctggtggctggcgtaatagccgcggtccatgtcggacagcgtcagggaagctttgtaaatggtggcggtcagggccatggcggaatcttcgcgaagtcggtaagcccggcgcggggtgcggcgcgggcggtcgattctaaccgcagccggggccgggcgccatgtttcatggggtcggctggctggtgcactccagcgattcgctgcgccaattgacgctggcatcgcggcccttgatccagaactccacgccctggccgacatagcgcgcgccgctgccgctcaagccctggtgcacgatgaccagggtgttgccgcgctccagcttggcggtggccggatgggtgcggtagaaggtggccagaatggtggacgaaggctggccgcggcacaggtagcgcagcggcgtcagcgacggcgccaggccccaggccgcctgcaactgcgagatgcgcaggatgtaggtgtcgcccaggcacatgtgcgggtcttcgttcttcaggcagtccttcaggctcttcacccagcgtttctgttcgccgaccagcttggcctgcgcgccgttgcggctttgctccgcctggcccatcgcctgggcgtagaccttttccaggcggttgtccagccgggtcaggccgtcgtcctggcacaccatgctttccaccatattggcgggcttgtcgcagtggaagtcggtggcgaccggcggcggcgcgtcgctgttttcttcggccggcttgaccgcgtccgcggcggcgtggccggagccggccgcgtgcggccggtcgttcttgccggccagcgccagcgcggggagcagcagcagcaagcctatcagcctgtgcgaggctatgggcatattcaatcctcgaaaacgactacatggagcgagccggcggcgcgccggctcctgtgcgcagggccaaggccatcagttcccaaccccggcgaatgtctgtacactgcgacgcttcgcgcgtgtgccagtcccgcgcgccttatctcatccgagttcaacttcttttcccgtcagcctggattggtcgcagttctgcgataggccgtcgcaggagcatattatgtccgatcttacctttgccgacctaggcctggcagaccctttgctgcgcgcggtcgccgacaccggttataccacgcccaccccgattcaggctcaggccattccgcaagtgctgcaaggcggcgacctgctggccgcggcgcagaccggcaccggcaagaccgccggcttcacgctgccgctgctgcagctgctgatgcgttcgcccagccaccatgccggccgcccgcgcgcgctggtgttgacgcccacccgcgaactggccgcgcaggtggaggagtcggtgcgtacttatagcaaatacctgccgttgaagtcgctggtgatgttcggcggcgtcaacatcaatccgcagatcaaggcgctgcgctcgccggtggatatcctggtggcgacgccgggccgcctgctggaccacgtcggccaaaagaccgtcgacctgtccggcgtcgagatcctggtgctggacgaagccgaccgcatgctggacatgggcttcatccacgacatcaagaaggtgctggccaagctgccggccaagcggcagaacctgctgttctccgctaccttctccgacgagatcaaggcgctggccgacaagctgctggacaatcccaagctggtggaagtggcgcgccgcaacaccaccaacgaactggtgacccagaaggtacacctggtcgaccgcgacaagaagaccgagctgttgatccatctcatccgcgagcacaattggttccaggtgctggtgttcacccgcaccaagcacggcgccaaccggctggcggagaaactggacaagatcggcatcacggccgccgccatccacggcaacaagagccagaacgcgcgcacccgcgcgctggccgacttcaagagcggcgaattgcaggtgctggtggcaaccgatatcgccgcgcgcggcctggacatcgatcagttgccgcacgtggtcaacttcgagctgcccaacgtgccggaagactacgtgcaccgcatcggccgcaccggccgcgccggcacgccgggcgaagcgctgtcgctggtttgcgtcgacgagttcagcttcctgcgcgatatcgagaagctgatcaagatgtcgatcgagcgcttcaccgtgccgggcttcgaggccgacctcaacgtcaagccggagccgatcccgatgggcggcggcgcgcgcggccgcggccagggtcaaggccagggccgaggcggccagggacgcagccagcagccgcgcaacccggcttccaagccgcgccatcaaaccgaaagcaagccggccggccacggccatcgcggcggcggtcagggccaaagccaggcgcgccaggacggcgcccgctcgcctaagtcgtcggcgccgcgcgccgcgctgttcagcccgccgaagagccgctaagcaagctgtttagacgatgggcccggtgtgaattgcaccgggcccattcgcattgaagcgcgtcgaattgccggttatgctcagcaagagactgtctgcagcatataaaacaaaggcagcttgctgactttgcaagaatcgggaaaacgatgcgataccacggctatctgctgggtatcctgagctgggccgtgctgctggcggctccggttgaggctgccccacgcctcaagatcaccctgtccaatcaggaatggccgccgtacatgggccaggaattgccgtacgacggcattctgtcgcggctggtgaaagaagctttcgcccgcggcggcgtcgatgtcacctatcgctattatcccaacaaccgcacgctgcagtcggcgcgcaacggccaggtggacggcagttttggctgggcgccgacgccggatcgcaagcgcgacctgctgtacacgcagccggtgctgtcggcgcgcatggtgtttttccagcgcaaggagcgcaggctggagtggaaccgctgggccgatttgcgcggcgtccgggtgggcgtcaccgtcggcaatttctattccgacgatttcgacgcccaggccaagagcggcctgctgacggtggacagcgcgccggacgacctgatcaatctgcgcaagctgctggccgggcgcatcgacctgttccccatcgacctggaggtgggcaaatacctgatcgcccaccattttccgccgcagcagggcgccctgctggaggcgcaggccaaatcgttctggtcggcgccgctgcatgtggtgatctggcgcaagcatgcgcgcggcaaggagctggtggagcgtttcaaccgcggcctgaaggcgctgcaggacagcggcgaattcgagcggctggtgacggaaacgcgcgaagcctgtctattgcccagaaccgtctcgccctgaggcggcgtcagccgcctgccagcgccgcgcgcgcttcgtccagcatgcgctgcgacagctcgtcgtcgctgaccgcgcgcgccagcagcagcgcgcccaccatcagcgccaggctggccagcggcggcgggccggcgccgtcgcggcggcgggcttcttccagggtttccagcatcggcagcaagccgtcggtgaagcgccgcctcaccgccggcccctggcgcgccagctcgccggccagcgccgccgccacgcagccggagtcgggaaaatcgcgatgggccgggctcaggtattgttccgccagcgccgccaggcatgcgccgtcggccgcctccgccagttgttgccgccagtggcggttcatctgttcctgggcttcgcagcaggcggcggcgatcagcgcgtccttgccggaaaagtgggcgtagaagccgccatgggtcaggccgaggtcggccatcaggttggcgatgccgacatgggccagcccttcggcgcgaaagcgcagcgacgcgatcgcgatgatgcggcggcgggtctggagcttgtggctgccgggatagcgcattggacctcctgctcgggcggtttggcatgataactataatataaacattgcctaagggaatcagcgggatagcgtcggccgcctggttccgccgttttcagcggaggcggcccatccatcctgccccattccattccgctcgcgcctttacccgagcgccggcctgtcccggcaaaaaacgttcacatcatggcgcggcttgcgcatggatttgcgcgcggcgcgcggctaatctgaaatgcataataagcggacgacattcaacgatccgcgctggatggagccaagatgccgccaagcaatgcctcgatgcgcaatctgggggacgcggcgctgcgccaaggcggcgccgcgctggcctatgccgttttcgcgctggcgctggcgcggctgctgccgcccgggccgccggcggcctggctgcagcctggcctgccgttggcgctggcgctgttgtcgcgtctgggaaaccgggtttggccggcgctggcgttggccggtctgtggctggcgtgggatggagccgggcggatggccgatgtcctgttgcaggctgccagcggcctgggagccgccttgctgggcgccggcctgctgcggcgccggccgccgcatctccagctggccgacgtgccggccgggttgccggccgccgcggcgctggcttgcctgctggcggcgctgggccaggtattcgcgttgctgccggaatatggccggcgcctgccggagctggcgctcacgggcgtgcagatctggctgggcgacatggcgctggtgttgacgctgacccccatcctgctgctgctgggcaggccgggaccggcttgcggcgcggcgcgctggcgcgagagcgcggcggtggcgctggccacgctggccttggcggcgctggtgtgctgcttgctggatggcggcggcggccgctacgctatgttgccttacctgttcatcatgccgctgctgtggctggctttccgcggccggccgctgctggcgcacctgctggcgctgggcgtggcgtcggccgcgctgcttggcgtgcgtctggggcatggcgcgctggcgtcggacggcggcggctacccgctgctgaacgcggccttgctggcgctggcgcagtcggcgaccctgctggtgttcggcgcgttgttggaggagaggcggcaggtggagcggcgcttgctgctggccaaccagtcgctggaggccaaagtgcgggagaggaccagccagctggcggaaagcgaggccaggctcaggctgatggccgacgccgcgccgtttccgctggcgatgaaccgcttgtccggcggccagctgatctacgccaacacccgcgccgaggagttgttcggcgcgcggctgctgcccgagcgctcgctgcgggtgcaggatttctacgccgacccggcggagcgggagcgggtatcgcgcgacctgcgcgccgccggccaggtgctggaccgcgaggtgaagctgaaggatgccgacgggcgcgagttctgggcgctgatttcctgttcggcggtgaagagtgacaagatctggtacgtgatcaatggcgtcaacgacatcagcgagcgcaagcggctggagcagagcctgcacgacgccaacgccgcgctgcgccgccatgtcggtgaaatcgaggtattgcagcagggcctgcgcgagcaggcgctgcgcgatccgttgaccgggctgttcaaccgccgccatctggacgaaatcctgccccgcgtgctggcccacatgctggcgctgcaccgcgatgtggcggtgctgatggtggatgccgatcatttcaagcgcatcaacgacagctacggccatcgctgcggcgatatggtcctgacggcgctggcggcgtatctcagcgatcatttccgctgcggcgacatcgtctgccgctacggtggcgaggaattcttcgtcttgctgccgggcgcgtcgctggaggcggcgcacgccaaggcgcaaggcttgtgcgacgcggtccgcgcgatgccgatccgggcgcaggaacatgtcttgtccatcaccttgtccgtcggcctggcgctcagcccgatgcacggcgaggatgcggaaagcgtggtccacgccgccgacgccgctttgtaccaggccaagcaaatggggcgcgaccgggtgtgcgtcgcggcgacgcttcagcccttgccgtcctgagcgtcgcgccggcgctggcgcagaaaccaggccagcgcggcgaacagcagcgcggcgagcagcgtgtcctccacccgttccagcgcgccgctggccagctgttccggcggcagcagcgacagcaccagcgcggtcagcagcgcgacgaagacgcggaagctgtgccgcatcgcgatcagcatcgccatctgcagcagcgccagcgccagcacgtgccacaacggcgccgcgtccagcgcgcgcagcgaccagtacagcaggccgctgagcagcgcgccggcaagcgtgcctatcgcccgctcgcgcgccagccacagcatctggtccggcgacggatcggggatggcgacggcggcgatcggcagccaccacgcgtgggcgctgcgcatccagccgccggccagccaggcgagaatgccccagggcagcagatgccagccatagcggcgacagtcggcggacgaggcggccggcagcacgcggaaccagtcgcgcagccccagccgcgccagcgcgccgccgtagccggcgccggccagcatccaggctgcttcctgccatggcggaagcgccgccgtcggcgtcatgtttcccaacagcagcgcgaacagccagaactgcacgcccttgtgcaggccgcggcgcgcgctcagcgcctgcagcgccagccccgccgccagcagggccagcatggccgccggctggccggcgcatagccggccggcgaggtaaagcccgggaatcgccagcagcgacagcggctgcaagcggcgcgccatcatcatgcacagcgcgctgtagttggcggccagcgcgaacaggaacacgccgccgccgtggccggccagcgtcagccccgccgccggcgcgaacagcagcgcgctgaacagcgccgcgcgcaggatgcgccgccgctggtaacgcacccatcccaggctgtgcagcgcgtatttcgggtaggacatgccgggggtctttcgttcaatccgctcccgatgactatggcgtcgcgcgccgccgcaggcaagccgggcaggcgcgcggcgcgcgtgctaccatccggccatggaactctatcgactgttgcaacaacaaggcttcggcggccgcaaggaatgccgccagctgatcgactacggcctggtggaagtgaacggcgaggtggtggacaactaccgcgcccagttcgagctggccgacatttccagcttgacggtggacgacgagccgtggccggtggtgcgcgggccgctatacctcttgctgcacaagccggccaattacgaaacctcgcacaagcccaactgccaccccagcatctaccggctgctgccggaccagttctccaatctggacatcagcgcggtgggccggctggacgtggacaccaccggcctgatcctgctgtccaacgacggccagttcatccacgcgctctcctcgccgaaaaagctggtgcccaaggtttaccgcgtcacgctgaagcacgaggcgacgccggagctgatcgcccaactgcagagcggcgtgtacctgaacgacgaggcgcgcgagttcgccgccgacagcgtagcccagatcgacgcgcacaccatcttgctgaccatcaccgaaggcaagtaccaccaggtgaagcggatggtggcggcggccagcaaccgcgtcgaggcgctgcaccgcgaaagcctgggggctattgtcttgggcgatctgccggcgggcgaatggcggcatctgacggccgaagaattggcggccttcggcttctgattgaatccgaaagccaaaaacggcgaggaacgcgtctccccgccgtttttttattgcgccgcggctccggtcatcgccggccccggcgcggccacgtgcgcgcagatgccctccttgtccggcgcgatgtggtcggccagctggtgtccgtccggatagtcgccgccgttctggcggcggaacgggatgggcgcttcgtcgaacaagccggccaagcgcgtgcgccacgcgtctagttgctggcgcaggtctgctgcgctcaaatggttgacgccatagaccgcgtgggtgggcagcacgtccatgccggggtagaacaggcagccgtgggtgaccgggaacagcagctcctgcagcgggccgttgatgccgcgcggaccgtagtcccgttcgccgccgcctaccatcgccgccagcagcgcgcgtttgcccttgagcgcgccgtcgccgtagcgcagccggttggcctggttctggtagccatagccgaagccataggcgtacaccctctcgaaccagcctttcagaatggccggcacgccgtaccaccatagcggaaatatgaagatcaccgcgtcggcggccagcagtttgcgctgctcttcggcgacatcgggcgtttgcgcgccattggcgtaggcgtggccggattcgtcgatgaaagacaggcggccgggatcggcccgcgccggaaaatcgtcggcgtccagcaccgctttccagcgcatggcgtagagatcggactgcagcgcttgatgcccttgcgccgtcagcgtttccacggcggcggcggcgaagccgcgggtcagggagcgaggctcgggctgggcgtagaccagcaatatcgtgcggcgcatgcgtggactttcaatggggtttcgatggcgtcagtgtgtgccggcatgataaataagtgaaatcgatgcttttctgatgagctatctgtttcatggataccaagcgcctggatttgaatctgttgcatacgctggaagcgctgctggaggagcgcaacgtcacccgcgcggccacgcggctgcatctgagccaaccagccgtcagcgcgcagctggcccgcttgcgcgaactgttcggcgatccgctgttgctgccgacgcagcgcggcatgcgtcccaccgccaaggcggagcagttgctggcgcccttgcaggcctcgctgcaacagctgcgcgaaaacctgctggcgcaccaggcgttcgatccagccgccgccagcatgactttgcagctcgcctgcaccgattacgcccaggcggtggcggcgattccgctgatccagcgcttgcgcctgcgcgcgccgggcatcagggtggcgctgcgccatctggaagcgtcccgcttgcagcgccaggccgagagcggcgaggtggatctggctttgatcagcccggatggcgcgccgccaggcttgcatgccaagcccttgtttgaagaccgctatgtcctgatcggccggccggggcatcccgcttggcggcagggcctcagcttggagagctatctgcagcatcagcatgtggtggtgtcgctgggcagcggcgatttcagcaccgcggtggatgcggcgctggccgagcaagcgctggcgcgacgggtggctttgtcggcggcgtcttttctgctggtgccggaaatcgttttccaaaccgattatctcgccttgctgccggcgcggctggtggcggtcagccgggtgccgctgcagacggaggcgtgtccgtttccgctcagcggcttcggcgtggcgatggtctggcatccgcgcaaccacagccatccgggccagcgctggatacggcagcagtttgccgagttgatggcagagtccgccgcggcatagcgtagccgcgcttatttggcggttttgcccaagcggcggtacagcgtggcgcggctgatgcccagcgcgcgcgccgccgcgctggcgttgccgccgcagcggcgcagcaaatcggcgatggcgctgtccggcaccgcatggccctggcttgccatatcggcgcgcagcaaggccggcagatggcggatttccagttgcgcgccgtcgtcggccagcgccagcaaggtggccagcaaattggccaattcgcgcagattgccgggccagcggtagccgcggaaagcccgcgccaactccggcgccagcgcgatgccgcgccgcgccgcgcccatttcgtccagcatgcgctgcgcgatggcggccacgtcgccgcgctcgcgcagcggcggcaggctgagcggatagtggcagagccggtaatacaggtcggcgcggaaagcgccctcgtccaccttggcgcgcaggtcgcggtgggtggcgcagatcagccggatgtccagctgttgcgccggcccgccgcccagcggcgtcacttcgcgctcctgcagcacccgcagcagccgcgcctgcagggccagcggcatgtcgccgatttcgtccaggaacagcacgccgccgtcggcctcgcgcaacctgcccttgctgccctggcggttggcgccggtataggcgccgggcagatagccgaacagctcggcctcgatcaggccttcgggaatggcggcgcagttgaccgcgacgaagggttggccgcggcggctgccggcgccatgcagcgcgcgcgccaaccggtccttgccggtgccggtttctcccaggatcagcaccggaatgtcggcctccagcagcttgcgcgcggcggcgaacaattcgggcggcgcgccgtccagcggcgcgatggcggcggcgggcgctgctttcgccagcggcgcggaccgaggcgaacggctggcagacgcggccgattgggcgggagccggcggcttcagccgggcggagaatcgttgcgcgccgattcgcagcgcgccgatggcctggccatggcgttgcagccagtgctccaggctttggccgaacagcgcggcgaaatggcgcgcctgccagccgccggcttccagaccgcacagcgccaaacccgggcggttggcggccagcaggcggccatcgccgtcgaaaaccagcttgcaggcggagggcgcgtccagcaggcgcggatcggcgtgcaggcatagcagccagccgtggcgggcggcgtcctccagcaagcgcgcctcgatctggccgcgcgcggcgtgcagcgccaggatttgcggcggccccagcttgcggctggcgccgctgatgtccagcgcgcccagcaactgtccctgcgggccgagcaagggcgcggcggcgcaggccagcacccggttgcgctccaggtaatgctcgccgccgcgcaccagcacgctgtccatcgcggccagcgcggtgccgatggcgttggtgccgcgcgcggcctcgctccagtccatgcccggcgtcagcgccagccgctcggccttgttcagaaaatcgatatgcccgctctggtccaggatcaggccgtggctgtcggccaccaccagcgccagctgctggctggccacttgttcgtacaagccggccagcgccggcgcggccggcgccagccagtcctggttcgcctgctgcctttcgttcagctccatcgggctcagcttgtcgccgccgccgccgccggccggcagacccaggctgcggcagcgttgccaggagtgcaggatgggtggcggcagcgcctggccgggcaagggctggccggtgaagaaacggcggcggatctcgtccagcggcaaactgcggacagcgttcatgcgcggctcctggcctgcctcgccacgctgcgacaggtgtcgcggcgcgagacagtttgattggcgatacggccgattatcgccgcatccgcgcgcttggcaattccttgattccgcgagaggtttgctgcgttgcgcaatggagagtccggcggcttcgccttgcaagggccggtgcgatggtgcaatgcagaaatcataaatctggcacggcgcttgcgctgttgcgcaatccgctgaacggatagccaccatccaccagacgaggagactgaagatggcaagcctgcaacctggatttcaattgaagacgcgttacgccaatttcatcggcggccaatgggtgccgccggtgaacggccgctatttcgaaaacgtcaccccgatcaccggcaagaccttgtgcgagattccgcgctcggacgagcaagacgttgagctggcgttggatgccgcccacgccgcccgtttcaagtggggccatacgccggtgaccgagcgcgccatcgtcctgaacaagatcgccgaccggatggaggccaatctgaacctgctggccgaggtggaaacctgggacaacggcaagccgatccgcgaaacccgcgccgccgacattcctctggccatcgatcatttccgctacttcgccgcctgcgtgcgcgcgcaggaaggcagcctgggcgaaatcgacgccaacaccgtgtcctaccacttccacgagcctctgggcgtggtgggccagatcatcccgtggaacttccccatcctgatggcggcgtggaagctggcgccggcgctggcggccggcaactgcgtggtgctgaagccggccgagcagacgccgctgtccatcctggtgctgatggaactggtgggcgacctgctgccgccgggcgtgctcaatgtggtcaacggcttcggcgtggaagccggcaagccgctggccagctccaagcgcatcgccaagatcgccttcaccggcgaaaccggcaccggccggctgatcatgcagtacgccagccagaacctgattccggtgacgctggagctgggcggcaagtcgcccaacattttcttcgacgacgtggcggcgcaggacgacgccttcttcgacaaggccatcgaaggcttcgtgatgttcgcgctgaaccagggcgaggtgtgcacctgccccagccgcgcgctgatccatgaatccatctacgaccgcttcatggaaaaggcgctgaaacgcgtcgccgccatccagcagggcaacccgctggacccggccaccatgataggcgcccaggcgtcgcaggagcagatggacaagatccagagctacctcgccatcggccgcgacgaaggcgccaaggtgctggccggcggcgcgcgcgcgcaactggccggcgagctggccggcggcttctacatccagccgacggtgttcgccggcaacaacaagatgcgcatcttccaggaggaaatcttcggcccggtggtgtcggtgaccaccttcaaggaccgcgacgaggcgctggccatcgccaacgacaccctgtacggactgggcgccggcgtttggtcgcgcaacatcaataccgccttcttcatgggccgccacatcgaggctggccgcgtctggaccaactgttaccacgcttacccggcgcatgcggccttcggcggctacaagcagtccggcatcggccgcgaaacgcacaagatgatgctggaccactaccagcaaaccaagaatctgctggtcagctacggcgaggacaagctgggctttttctgagccggcgcggtccttgggccggcgccgcggttttgcaaagccgcccatctcgggcggttttttcatgggcagcgcggcggcggggatgaaggctgccgagaggagcattttccatgacgacttgattgcgggatttatggatttcgcctagagcaataagctaaatattatttatttaatgatatacatgttttatttacgtaatttataacaaatacagggggtggactgggtggtatgctattcgggtcgcaaagggctgggcccgtgggagagcacgcatgcagtcggaccgggaaatgagcatccatggcgcggaagagggcgacgcggcgtacgaacagcccgagcgggcgctggagctggtctggctgcggcgttatctgccgcagcagttcgccggccgccaggtgctggaatgggcgtgcggcagcggttactggacgcaatacctggcgccgcgggcgcggcgctacctggcattggacgaggccgctgccgcgctggcgctggcgcgccaacggccgggcgtggagcgggtggagtttcgcctggcgcaggactgcgcgctgccggccggcgccggcggtttcgacgcggctttcgccgcgcagtgtttttcgcggctgcccaagcagcgccgcgacgattggctggctggcctgcacggcggcttgcaggccggcgccgaggtgctgtggttggacgacagcgaggcgcagtgccgcgaatatccgctggtggagtatgacgcggcgggcaacggctaccagatgcggcccggacccgacggcggcgagctgcggctattgaagaactttcccagcgaaaccgaattgcgcatcctgctgggccggcatggcgtcagcgacatggccttgctgcggcgcgagcatttctggctgctgcaataccgtttgccgaagcgccattgaggcgccgcgcgcggacgtgaaaaagccgggctgggcccggcttggcaaggggaagaggggacggactcaggccgcggacagctggtccaggccctgctgcagcttctggctggcctgctccatcgcctgcatccgcgcgacgatgccggcctcgtccagctggccgctctggctggcggcggccagcgccgcgccgacttgctgctgcagctgcgccagcggctggcgcagcgcctgggtggcggaggcgccgaacaggctggcgccgccgccgtctatccagtgctccagctccaccgccggggcttgggcctcggcttcctcgatcgcgtggtaagcgctttgcttgtagatcacgtgcgccactttctgcagcgaggtctgcgacttctgctgcacctcgctcacctgcttcaacacccggtcggattgctcggccaggctggcaaagcgctggcggaacgattccaccgatgtctgcacattgccggccacgccgccggcgtcgctggcctgcgcctgcatgtcggcgatgcgggtggacagcgattccagcacattctgcacctggttggcggtgctcttgctgcgctcggccagtttgcgcacttcgtcggccaccaccgcgaagccgcggccggtttcgccggcgcgggcggcttcgatggcggcgttcagcgccagcagattggtctggtcggcgatggccgagatgtcggccagcgagctttctatgccctgccattcctgggccagcagctggctggcctgatccatgctgttgacgctgccggcgatggtatccaggtggctggacaattccgccgcgctgtccaggctttcgcgcgcgccggcggcgttgtcgcgggtgatgccggccaccgcgtccatcgcctggctgatggcggtgaggtcgtgctggctgccggacaggtcgtgacgaaggttggggttgttcagcgccgccagttgcgacgacagccggttgcggcgcacgaagccgtcgttgtcggccatggtctggatggtcttgttcacgttctccagcgagctggccaggatgccgggcaggccttggttgagcggccggcgcgagaagttgccctggctgatctcctggaagcaggtgttgatttccttgaagtaggtttccaccaggtcgaggaagtcattcagctgccaggccacctggccgacttcgcccatttcgcgggtgccggtgctgcggtggtgcaattcgccgctgcaggccaggcccagctggcgggtgagggcgttgagcaggaggaagatgcggctgcccttttgccacagccagcaggacagcgcgatggtggcgatcagcagcaggacgctgaccgcggcctgggcgccggccggcagcaggtagtcgtcgacgatggacagcaccaccagggcgttgaagcccgccagcacccaggccagatgcgagcgcaggaaggggctggctttgcggggggaactcatccggtgactcctttggctttcagtacgtcggcgttcagccccaggatgaagtcctggtagctgcagcctttttccgccagcagcgccagcagccagtcgcgcgaggcgtctggcgcggcggccttgccctggctggcttctatcttgcgcatttcggcgtagatcggttcgatggcggcgatggcggcgcggctgggcgggcgccgcaccgagtagtagccctgcaggcggccttgcgggtcgtaatcgggcgtgacgttggccagcacccagtagtagttgccgtccgcggtggcgtttttcaccagcgcgaagaattcgtggccggcctgcagcgtctgccacatcagccggtacgcgccgcgcggcatgtcgggatggcggatcaggttgtgcggcttgcccagcagctggtgctcggcgtagccggccacccgcatgaacacgcggttggcgtaggtgatgtggccgctggggtcggtcttggtgacgatcagttcgtgcggcgcgagctgcacttcccggccggcgcctctgccgatggctgttttttccattgtctgcttctctttgaccatgctctttgtagtattgccggcaaattggcattgtcatgtcctgtgcatgacagggcaaggatttattgcgaaatggtttaagttaaaatcattttatttaaatcgaatgcttgctggcggcaaaaaaggggaggccgcgaccatcccccttggcgccgacatcgcgcgccgggtttacagcttcaggatctgccgcacctgggtggcgcaggcgcgggcctggcggctgagcgcggcgaattccgggctgacgatgtcgtcgtggctcagccagcgcaccttgctgctcagccggtattggtagcggacgccgctggcgtcggcggtttgcttcaggtccaggtcgaaccagggcgagcgcgcctggcagctgaacggcggctggatggccttggcgcctttcagttccagcgagcgctccatgatttccgggtcgcccaggtagacgtcggcctggttgccgttggcgcggtagttgtcgaagtcgttccagcggctttccaggcgcgggtcgtacaggtagaggccggagatcttctccagcgcgcgggtgtcgtcgccgcttatctggatcgggtaacgctccggaatcaggaagccggtggcggcgcgcgccaccttgcagttctgcgtctggttgccgaggccgcggcagatgttctggtcggtgccgctgctgccctggtagcggtcctgcatcgtcatttcgatcaagggccagctggccagcaggctttggctgacgatgcgcgcgctgctgtcgcgtttcagggtttcgacgcgcttgaccgagctgctgagggtggccgcctgcagcggaatgaagtcctggcgcaccttgccgtcgtcgcccatcaggtaggtcgcgcgctcctgcaggtcaggcatgatgcggccggcggcgaagaaggggttggtggcgtccagccactcggttttgccgtccacttgcgcgcgcacgatcatgtggttgacggtgccgaggccaggcagcagcggctgctgggcgaagttgccgcggaagaccagcgccggttcggcggcgatgccggcgcggcgcagcatcgcggtcagcaaggtggccaggtccttgcaatcgccgtagccgtgctgctcgatttcggccagcgtgaacggcaccaggccgcgttcggccagccgctggtcgttgaggtagcggtaatggctgttgatgtgctgcatgaaggcggccacttgctgggcggccggcttgccgcgctgctgcgacaccaccgccgccgcgcccggcggcaacggcgccgccaggatggcgttgtagcgctcggcgtagacgccgaaatgctgctgcggcgagtcgctggtggcgatgctcagccgcggccagcggcgcagcgcgctattgctccattcattggtgaggttcaggtagcggctgccgcgctggtcgacggtgatccgcttgccgtcggcgctggccgcggtctgaaagccttccatcgcttcggcgcgccacagcagcggccgcggcgaatccagctcgaaatgatagctgtcgtagcgcaccggctcgggatcgaagtccagccggtacagcagctcgcggctgagcggcggcgcggcgatatggtgcctgacctggtaggacaccacgctgcccaccgccaattcggggaaggccagccaggtttgcttgtcgcggctgacgccggcgtaggggttgggcgcggcgcgggtttccacctgcgacttttccagcttgaccaccttgccgtcctgctggcgcacttcgccgcccagcacttccagcttgtcggtgtccgggtaggtgaaatctatccgcgacaaaaactccttgccggcgggtttgaggatggtgaattggttgcgggtggtgcagtccaggctgttgtcggcgttgtggcggcagctgatgctggccttcagcgccagcggcgcctcttccgccggctggcgcgccgccagcgcggcggggccggccaggaccagcgtggtgctcaacagggaaacgggaaaacgcatcgggaaaccattcttggctggcgcgccgcggcgcgcggggtgggtcgatagatgaggcaataatcttgccatggccggctggcgcaggccagcggcgcgggaatatggcttagtgtgggccggcggcgcggggttccgcggcggctgcccagccccccggggcgggaagcgggctggcgctcagggcgcggcggtgacgaagcctatcttgccgacgccgttgctctgggcggcggccagggtcttggccacggtttcgtagcgcacggccttgtcggccgacaggtgcagttccacctcgggattggcggcggcggcggcggcgaagcgggccggcaggtcggcttccgccaccgccttgtcgttccagaacagcttgccggcggcgtccaccgccaggcggatctgttccggcttgtcctggtgctgggcggcctgggcgcgcggcaggtccaccttgaccgcgttggtcagcagcggggtggtgatgatgaacaccaccagcagcaccagcatcacgtccaccagcggcgtggtgttgggctcggccatcggcgcggccgggccctggttgaaactaccgaacgccatcttgctctccggattgggtcaacaactgggcgtgcaggtcgtgggcgaaatagtccagttcctgcgacatcacgcgctgggcgcgggtgagggcgttgtaggccagcaccgccgggatggcggcggccaggccggcggcggtggcgatcagcgcttcgcctatcggcccggcgaccgcggctatgctcatctggccggcctggccgatattgaccagcgcgtggtagatgccccagacggtgccgaacaggccgatgaaaggcgcggtggagccgatggaggccagcacggtcaggccggcttcctggcgggcgttttcctgcgccagcgccttgcggatggcgcgggtgaggaattcgtcgacgccgcaagcctggcccagcgcgcgtccggcctggctttggtactgcttgagcgcggcgaggccggcgcgggtcaggttggccacctgtccgcggctgtgcgccaactggtgctccgcctgcgtccagccggccgcgctccacagcgcgctctcggcgctgcggttggcgcggcgcgcctgcagggtctgcacgccgcgcacgatgatcaggtaccaggtgagcgccgacatcaggatcaggatcaggaacaccgaaatcagtacggcgtcgccttggtggaatacggtcattagattcatggtttgccaggcttcaaagaaaattcgatagggacgataacgatgacaggaatggcctggccatcgcgtttggctggggtgaagtgccagtttttgacggttttcaatgcggcggcgtccaattgcgggacgccgctgctgctaatcagggcgatctcctgcggcaggccttcggcgctgatcagcacccgcactttcgcgagaccggcttggcctgccgctatcgcctccatcgcttcctcggacaaggaggaggtttgcttgcggcgggcttgatcgtggccggcgggactaggttctgccgcggcgttcgtcagcatcagcatggccgccgccagcgcggcgccggcctggcgatatgcggcggcgctcatgacctgctggacttcaaggaaaactcgaccggcacgatgtaggtgtaggcgatgggctcggcgccgcgcttggccgggatgaagcgccagcgcttgaccgaggccagcgcggcgcggtccaggcgcgggaagccgctgctgctttgcaccgacacttcttgcggcaggccctgcacgctgacatggacgcgcaggcgcacggtgccttcctcgccttcttctttggagacggtggggtaggcgggctgcggattgttcaggtagccgccggtggacagcggctcggtgatttgctgctggcggctgtcgccgtccggcttgccgccgccgggcgctttggccggctccgccgccggggcagcagaggctgcgggagcggcggcggccacctggatggccttggcgggcgccggcggcggcgtgtcggttttctgcggcttcactgccggcagcggccgcgtctgcgggatggccttgctaggcgcggccttggcctggacctgcggtttctgcggggcggcgggagacggcgcggcggccttgggcgcggccgccggcgccagcatcgtcatcgatgtcagcagccgcggcggcgtcaccggcagctcccggccgggctggccattgagcaagcacagcgccagcgcatgcaggcccagcaccgcgccgatggcagaaagttgcaaggttggcaggggtttcatgaaatcgatgataatacaaataattctcattatacaacagggcgcggccgcgccgcgagcaaacgctgcttgcaatcgccgcgatcgcctgcatattcagagctgagccggcgcatgccggcatccctgatatccattggaataccgaacatgcagcaatttgacggaaccaccatcgtttccgtccgtcgcggcgagcgcgtggcgctgggcggcgacgggcaagtgaccctgggcaacatcgtgatcaaggcgacggcgcgcaagatacgcaagctgcacggcggcaaggtgctggccgggttcgccggcggcaccgccgacgccttcaccctgatcgagcgcttcgaagccaaattgcagaagcatcagggcaacttgctggtgtcggcggtggaactggccaaggattggcgcaccgaccgcatgctgcgccggctggaggcgatgctgatcgtcgccgacaaggaccacacgctgatcatcaccggcaacggcgatgtgctggagccggagcagggcatcgccgccatcggttccggcggcgccttcgcgcagtcggccgcgcgcgcgctgttcgagaataccgatctcgcgccggaggtggtggtgaagaagtcgttggagatcgccggcgacatctgcatctacaccaaccacaaccacctgatcgaaaccctgggcccggacgacgaggcctgaccccgaatgcaaggcccggcccgcgcggccgggcggagatcgtcatgacgcaaatgaccccgcaggaaatcgtccacgagctggaccagcacatcatcggccagcacgccgccaagcgcgcggtggccatcgccttgcgcaaccgctggcgccgccagcaggtggccgagccgctgcgcagcgagatcaccccgaagaacatcctgatgataggccccaccggcgtcggcaagaccgagatcgcccgccgcctggccaagctgtccggcgcgcccttcatcaaggtggaagccaccaagttcaccgaggtcggctatgtcggccgcgatgtcgacaccatcatccgcgacctggcggaagtggcgatcaaggaaacccgcgacgccgccatcaagcgcaaccgcgtccgcgccgaagacgccgccgaggagcgtatcctcgacgcgctgctgccgcgcgtgcatcagccgcaaaccggcttcttcgccggcgaaccggcggtcgaggacaagcatgaggacggcgccacccggcagaaattccgcaagatgctgcgcgagggcaagttcgacgacaaagagatcgaactggaaatcgccgcccccatcgcccagatgaacgtgatggcgccgccggggatggaggatttcgccagccagctgcagggcatgttccagggcctgggcgcgggcaagaagcaggccgccaagatgaaggtggccgacgccttcaagcaattggtcgacgaagaggcggccaagctggtcaacgaggaagagctgaaggcggaagcgttgaagaacgtcgagcagaacggcatcgtgttcctcgatgaaatcgacaaggtcaccagccgcggcgaaggccagggtggcgccgacgtgtcgcgcgccggcgtgcagcgcgacctgctgccgctggtggagggcaccaccgtgtccaccaagtacggaatggtgaagaccgaccacatcctgttcatcgcctccggcgccttccagttgtccaagccgtcggacctgattccggagctgcagggccggctgccgatccgcgtcgagctgtcgtcgctgtcggtggacgatttcaaggcgatcctgaccagcaccaacgcctgcctgacgcgccaataccaggcgctgctggctaccgagggcgtggagctggcgttcgaagagtccggcatccagcgtctggccgagatcgcctggcaggtcaacgagaaaaccgagaacatcggcgcgcgccgcctgtacacggtgatggaaaagctgctggaggaggtggctttcgacgccaagtccggcgagcgcaagatcgacggcgcgtatgtggactgcaagctgggcgaagtggccgagcgcgaagatctggcgcgctacgtgctgtgacgtgggttggcttctttccccggtggagagaagccaatctatatataaggtataacggcggcccgaaaggaccgccgtttcgctttatgccgattgttccagcttgccgcccgccggcgccatcggctcgaaagcctccgggtgctgtttcaggtaccagtccttcacctcgtcatggctcaggttcaggaagcggttgacgccgggcagcagcagcatcggcggcaccgtcagcaggtggaacagggcgaagaacagatagacctcatccagcgaccagcgcgccagcaggatgccggccagcgccggccccagcatgccgcccagcttggccaccagcacattgatcgccgacacccgcgcgcgatagggctccggcaccgccagcgtgcgatgggtctggccgatcagcatggtgatcgacagcagcgcgccttcgatgccgaacattgccagcatcaccagcggatgatcggtcaacgccaccaccaggaataccgcgccgagcgcccacatcgcgaaagcgcgggcgcgcggccggctacagtgcagcagcaggcggtgcgtcagccacagcgagccgaccagcaggccgccgctgaccgccgcctcgcaggcgcccagccagaacgccggcaggcccaattgatgcagcttgatcggcagcagcgtcaccaccatcgggaagtaggcggtcatcaccagcaagccccacagcgcccagcggcgctccagcggaatgcgccagcgcacgcgcaggccgctgcggatctgttcgatgaagctttccgcccggacatccgccaagctgcgcgccggcaaccggatgcgcaaggcgccgacggcggcgatggccagcagcagcgtatagctgcccagcgccatccaggccggcgccaccgccatcaggctgccgcctatgaccgggccgatcaggttgcctaccgattgcgagcttttctgcatcgacagcgcgtcggacagccggtttgccggcaccagctcggcggcgatgctcaacatggaaggaattacgatggcccaggcgaacatggccatcgattcgctggccaccacccacgccaatctatagaagtggaaccaagccatcgccgccagcgccaggccggacagcatggccagcaggatgccgccggcgatgacgcggtttttcgggaagcggtcgcccagcggcgcggtcagcggcagcgccaccagcatcaccagcgcggtcagcgtgctgaaccaggccatgtcgcgggcgccgcccatcgataccacccaccagctgatgctgacatagccggcgcccatcgccagcccgctcaagacgtcgctgagcatcagcagatggaaaccgggaggcaggccattcagtcgttgtcgtagggaagtctgcatggcgcgctccggtggggaaggcatttgatcctatcacgaaatgacattgtcacgccaatgtaggaggcgttcgcgatttctgacggtaagaatgaaaattcggccggttttggaggattttccaaagttatctatccagccaatcacggtggcaggcgggttttcagcggatttttcggaggctcaataaaaatgcaaactgcctatttgaatgaaaatcaatgacttgccgataattctgtaaaattcttcaacttttctcaaaaaagcggttgaccgagggggagggcgcaggtatagttcgtctcctcagctgacgcagcgaacgaaacagcggaaacgaaacggttccggtgatgacgacgcagcgatcggcaccgctctttaacagacagaataaccgataggtgtaagtgtttggcgaaagccaaaaacttgcactgcaagagacaagagatacttgtttatttctttgaacttgcgtgccagaaaatttgctatgagattgaactgaagagtttgatcctggctcagattgaacgctggcggcatgctttacacatgcaagtcgaacggtaacagggtgcttgcaccgctgacgagtggcgaacgggtgagtaacgcatcggaatgtaccgtgtaatgggggatagctcggcgaaagccggattaataccgcatacgccctgagggggaaagtgggggaccgtaaggcctcacgttatacgagcagccgatgtctgattagctagttggtgaggtaagagctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttcgggaggaaatcccgctggttaatacctggcggggatgacagtaccggaagaataagcaccggctaactacgtgccagcagccgcggtaatacgtagggtgcaagcgttaatcggaattactgggcgtaaagcgtgcgcaggcggttttgcaagtctgatgtgaaagccccgggctcaacctgggaacggcattggagactgcaagactagagtgcgtcagaggggggtagaattccgcgtgtagcagtgaaatgcgtagagatgcggaggaataccgatggcgaaggcagccccctgggatgacactgacgctcatgcacgaaagcgtggggagcaaacaggattagataccctggtagtccacgccctaaacgatgtcaattagctgttgggggtttgaatccttggtagcgtagctaacgcgtgaaattgaccgcctggggagtacggccgcaaggttaaaactcaaaggaattgacggggacccgcacaagcggtggatgatgtggattaattcgatgcaacgcgaaaaaccttacctgctcttgacatgtacggaacttggtagagatatcttggtgcccgaaagggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgagcagggcttcacacgtcatacaatggtcggtacagagggtcgctaagccgcgaggtggtgccaatctcataaaaccgatcgtagtccggatcgcactctgcaactcgagtgcgtgaagtcggaatcgctagtaatcgcagatcagcatgctgcggtgaatacgttcccgggtcttgtacacaccgcccgtcacaccatgggagtgagtttcaccagaagtgggtaggctaaccgcaaggaggccgcttaccacggtgggattcatgactggggtgaagtcgtaacaaggtagccgtaggggaacctgcggctggatcacctcctttctagagaaggcgatcgtcaagcacttacagcctatcggttattcgcgttaagggcagctggatcgaagagattcagtgctgagaagttgactgggtttgtagctcagctggttagagcactgtgttgataacgcaggggtcgtaggttcgagtcctaccagacccaccagttgggggattagctcagttgggagagcacctgctttgcaagcagggggtcgtcggttcgatcccgtcatcctccaccacttacagtgcaaacaaaaacgaacttgatcgagtttgattctgtttgcgttgttcgcgtgcagcgaaagctgctcagcaatacgcccgatctttaacaaactgaagaagccgaatatattaagacggcgaaacaaacagcgagagttaagtctttcgttgaatgaatcgtcatcttgggtatttgattgtatcaaaggctgcgtcgccatatcaaaaggggcggtgcagtcgtcgcacaaacacacttgttgttttagtggcttaggctgctgaaatgatagggtcaagcgactaagtgcatctggtggatgccttggcgatcacaggcgatgaaggacgtgtaagcctgcgaaaagcgcgggggagctggcaatagagctttgatcccgcgatatccgaatggggaaacccggcccttaggggtcatccctgactgaatacataggtcagaggaagcgaactcagcgaactgaaacatctaagtagctgaaggaaaagaaatcaaccgagattccgtaagtagtggcgagcgaacgcggaacagcctgtatgtgatagagattgcgttagtggaaggttcatggaaaggaccgccgtagtgggtgatagccccgtacacgaaaacgcattcttggtactaagcatacgagaagtagggcgggacacgcgaaatcctgtctgaatatggggggaccatcctccaaggctaaatactcgtgatcgaccgatagtgaaccagtaccgtgagggaaaggcgaaaagaaccccgggaggggagtgaaatagaacctgaaaccggatgcatacaaacagtgggagcggacttgttccgtgactgcgtaccttttgtataatgggtcagcgacttacgttcagtagcaagcttaaccgaataggggaggcgtagggaaaccgagtccgaatagggcgctttagttgctgggcgtagacccgaaaccgagtgatctatccatggccaggatgaaggtgcggtaacacgcactggaggtccgaacccactagtgttgcaaaactaggggatgagctgtggataggggtgaaaggctaaacaaactcggagatagctggttctccccgaaaactatttaggtagtgcctcatgtatcacttccgggggtaaagcactgttatggctagggggtcattgcgatttaccaaaccatggcaaactctgaataccggaaagtgcaagcatgggagacagacggtgggtgctaacgtccatcgtcaagagggaaacaacccagaccgccagctaaggtcccaaatgatcagttaagtggtaaacgaagtgggaaggcatagacagccaggatgttggcttagaagcagccatcatttaaagaaagcgtaatagctcactggtcgagtcgtcctgcgcggaagatgtaacggggctcaaactgataaccgaagctgcggatgggcgcgtaagcgtccgtggtaggggagcgttctgtaggtctgtgaaggtgtctcgtaagggatgctggagatatcagaagtgcgaatgctgacatgagtagcgataaagcgggtgaaaagcccgctcgccgaaagcccaaggtttcctacgcaacgttcatcggcgtagggtgagtcggcccctaaggcgaggctgaaaagcgtagtcgatgggaaacgggttaaaattcccgtacttttgtgcagtgcgatgtggggacggagaaggttaggtcagcagactgttggaatagtctgttcaagccggtaggcgtgaagagtaggcaaatccgctcttctttaacgccgagacgtgataacgagggtctacggacctgaagtgactgataccacgcttccaggaaaagccactaagcttcagctgcacaagaaccgtaccgcaaaccgacacaggtgggcaggatgagaattctaaggcgcttgagagaactcaggagaaggaactcggcaaattgataccgtaacttcgggagaaggtatgcctgttgaggtgtaggacttcgcgtccgaagctttgacaggtcgcagagaatcggtggctgcgactgtttaacaaaaacacagcactgtgccaacacgaaagtggacgtatacggtgtgacgcctgcccggtgctggaaggttaagtgatggggtgcaagctcttgatcgaagccccagtaaacggcggccgtaactataacggtcctaaggtagcgaaattccttgtcgggtaagttccgacccgcacgaatggcgtaacgatggccacactgtctcctcctgagactcagcgaagttgaagtgtttgtgaagatgcaatctacccgctgctagacggaaagaccccgtgaacctttactgtagctttgcattggactttgaagtggtttgtgtaggataggtgggaggctttgaagccaggacgctagttctggtggagccgaccttgaaataccaccctgacccctttgaggttctaaccttggtccgtgatccggattggggacagtgcatggtaggcagtttgactggggcggtctcctcccaaagtgtaacggaggagttcgaaggttacctaggtacggtcggaaatcgtgctgatagtgcaatggcaaaaggtagcttaactgcgagaccgacaagtcgagcaggtgcgaaagcaggacatagtgatccggtggttctgaatggaagggccatcgctcaacggataaaaggtactccggggataacaggctgataccgcccaagagttcacatcgacggcggtgtttggcacctcgatgtcggctcatcacatcctggggctgtagccggtcccaagggtatggctgttcgccatttaaagtggtacgtgagctgggttcaaaacgtcgtgagacagtttggtccctatctgcagtgggcgttggaagtttgacgggggctgctcctagtacgagaggaccggagtggacgaacctctggtgtaccggttgtcacgccagtggcatcgccgggtagctaagttcggaagagataaccgctgaaagcatctaagcgggaaacttgcctgaagatgagacttccctggaggcttgacctccctgaagagtcgttcgagaccaggacgttgataggtcgggtgtggaagcgctgtgaggcgtgaagctaaccgatactaattgctcgtgaggcttgatcctatcatttgagtggcttgggaaactgagacacaagagagtggatgtgcgacgtacgtcaaataccgaatatatgcgaatctgtctgagagacgggttcgggcttctttaagtttgtacagtttatgtctggtggccatagcgaggtggtcccacgccttcccatcccgaacaggaccgtgaaacgccttagcgccgatgatagtgtggcattcgccatgtgaaagtaggacaccgccagacgccccatacagaaccccagctcgatgagctggggtttctgcgtttcggccgccgcccgtggggcggcgccgtttcggccttgccgtcccctccccgttcccccgcggcttgccattgaccactgcgcgcatcccgcacaaaatcagccctttaccgactggaaggtggcagccgatggtttctcgcagcagcccggacgggcttgctgctgcgagaaaccatcggctgccaccttccagtcggtaaagggctgattttgtgcgggatgcgcgcagtggtcaatggcaagccgcgggggaacggggaggggacggcaaggccgaaacggcgccgccccacgggcggcggccgaaacgcagaaaccccagctcatcgagctggggttctgtatggggcgtctggcggtgtcctactttntctatcaggctggcgcggtcggcgccatcgcgcgcctgcagcgatatgccctgtatcacggtgaaatagaagtttgccaattgcttgcagtccgcgtccgcgggcagctctcccttgcctaccccgtcttccagccggctttgtatcagctggatggtgtgttggcggatttgccgcaaatagtcctgcagcgcgacgttgtccggttcgcaattgaccaggcccaggatcagcaggcagccgttggcccccggggaggccagcaccgtatccacgctggccagcagcatgccatgtatcgcttcggccgttgtcgccgcgctcgccagcgcgcgcatgctggcggagccttccgagtgcagatacagctccaccgcttcgcggaagatggcttctttggagcggaaagccgcgtagaagctgggcggcttgatgttcatcaccttggtcagctccgccagctgggtggcgtcatagcccttggcccaaaagacgcgcatggccgaacgcagcgcctgctcgcggtcgaagctgcgcggtcgtcctctgacgctcatatatttttcctttctttactttccactacataaatagttgacatttagatatttgggcggcatatttcgatttatgtatcagctgctacaaaaattaccagctagcgccatgcttgtctagcaaaggccggatttcgtccgcatgccgcgatgtttttgtcgcgcatctggcgagcagggcgctgcgcggaggtgggagacgggagagggcgcacagccatcttccggcgagatcggttcgttttcacttgaatggggtggcatgaatgaagtggatttcacaagcgctggctagacgcgggcaggggcaatcgactggatggtgggtggggtactgacacgatggctcagctagctgaactgcatatcgagtccgtgctgatcaatacggacaatctggccttgcgtccctggcgtgtcaaagaggtgcatgaattatacgcggcgatacaagacagccgctttcagcagtcgatgctccaggcagaccctttccatcaggccaatgccgcgatggccgccctgaaaagcgcgattgcccacccgcgggcgttgccggtggcggagttcgccatcacccgggtgcgcgacaacacgatagcgggttccgcgctggtcaagctgaccgatgcccgcaccgcggcggtggagatcgattacgccctgtatcccgcttttgccggccagggctatgaggccgaagtgctgggcgcgttggccggctggattctggagtgcggggccgcgcgggtggagctggtgtgcggactgggcgacatccatcgcgccaagaccgcgctggcttgcggcttccgctatgagggcgtgcagcgttgcgccatcgccacgctgcacgggctggagagcggcggcatgttcgccaggctgcccgaagatgccggcacgccattgcggcaggtttttcccgatttgcctcccgaggggctgagcgacggcgtcgtcaccttgcgggtcgcggcggtggccgacgtggaggccttgctggccgaacagaccaatgtcgaggccaggcgctggtcgctgatcgaaccgctgtcgcgctgcgatatcgccagccgggtcgagaaggccgcgctggaatggctggtcgggccgaatgcgtttttcagcattgtcgattgcgaaagcggagaggtggccgggcgcatcgtcctgcgcgcggtggtgccgccgcaggtggcggatgtcggctacggggtgttgccgtcgttccgcggccgccgttttgcctcgcgggcgctgcagctgctgtcgcaatgggcgttcgaacaagcgggctacgtgcggctggagctcggcgtcaaaccgggcaacgtggcgtcgcgggcggtggcggaagccggcggattccgcttcgacggcatgcgcaaatcccggctgcgcaatagcgacggcagcttcagcgacgaattgcatttcgttcgcgtcaatcccgcctatctggaaccggacgtgccgctggtcatcgccagctgagccgcgggcggcatcgcctagtttgcttaccttagatcaagaaagatggaatgtgatgacacaagatcaacttcaagacgcatcgctgagtgaaatgctgacggcaggcggacaaccgttcaaaacctggctggcaggcctggtggcgcaggtcgccggcgacgacaacgtcggcatgtaccggccgcgctcgcggaagggcgtgatccgcccgaatagcgtggagcaggtgcgcgacgtgctgcgcctggcctcgcagagcgaggaatccgtggccctgcatgcgctcagcaccggccggaactgggggctgggctcgcgggaggcggcgcaggacgcctcgctcgcgctggacttgtccggcctgaagcaggtgcgggcgctggatctggatgccggctgggcggtggtggagcccggcgtcacccagggccagctggcggcattgctggcgggaagcccgcgcatgatcaatgtcaccgcctcctccgcccacagcagcgtattgggcaacggcgtggacaggggagtgggcttgcgccgccagcgggtggaagacctggtgggtctggaagtagtgctgcccgatggcgaggtgatgagggtgggttggtggcccgacgccgagcgcccctccccggtgtatccgtacgggcttgggccgtcgccgctgcagctgttctttcaatccaatctgggcgtcgtgacggcggcggtggtgaggctgatgccgcgccccgaggcgctgcgcgtggtgcgcctgagcttcgcccgcgaacggctggccgaggcgatcgatgtgctgcagcgctggagcgcccagggaatggtgcgcggcgtgctcaaggtctacgacgcgaccgccggcgcgctgtatggcggcggcatcggcgaatacctgacccatgtctgcgtggacggcaccgctgccgtggtggaggcgatgaccacggtgatcctcgacgaggcaaaccgttccggcctgttcctgcacgtatcgcattcggatcagcgcgatccgcggctgagcggcaacgtggtggccgagatggtcgccagcgcctacgccggcgatcccagccgcaacgacacgctgctgcaggccacgctggggcaggatgcggaaaatatcgacgccgcgggccgcggctggctgttcttcctgccgctgatccccttccacggcgaagccatcgaccgggcccagcggctgctggcccaggtatacgacgagaccggcgtgcattgcggcgccaccatcaacgcgttgaactccgacgtcatcgactacgtggtcgccatcaagttcgagcgcaacgccgacgaggcgcgccgcgcccaccaggcgctggaccgcctgtaccagctgttctccgccgccggcttcatcccgtatcggctggatgtggatcaccaggactggatagacggcctgagccccgatcaggcggcgcgcgacttcgtgcgcggcatcaaggggatgctggacccgcgcgcggtgatcgcgccgggccgctacgcgtgaactccgccggccagcgccggccatcgaaaacgcattatcgaatttcatttcgcagggagtgactggaatggcttatctggaaaaagaaaacatgggtcaggcggccgccgacgaatggacggcggagcggattctgtcccgcgcccgcgaactggcgccggtgctgcgccagcgcgcggcggaaatcgagcagaaccgccacttgccggcggacgtggtggagctgctgcgcggcaccggcgtgttccgcatggcgatgcccaagtcctggggcgggcccgagctggattcgatgcagcagaccgaggtgatcgaggcgctggccatcggcgacgcctccgccggctggtgcggcatgatcggcgccgactccggcatctactccggctatctgcgcgaggaaaccgcgcgggagatgtttccgcggctggacatgatcaccgccggctggattcacccggaaggccgcgccgagcgcgtggccggcggttaccgggtgaccggcaactggcgcttcggcagcggcagcacccactgcgactggctggcggccggctgcgccgtttatcaggacggcgaacccgtgctggccgagaacggcaagcccgagtggcggatcatgtacgcccgtcccgatgaataccagatccgcgatacctggcataccaccggcctggctggcagcggcagccgcgactacgccgccgtcgatctgttcgtgccggaagagcgttccttctccttccgcgaaccgcgccgcgagggtccgctgcatatcgcgccggacgccatcctgcgcaagatgtccggcgtgccgctgggcgtggcgcgcgcggcgatagaccacgtgcgcgagctggcggcaagccgtttcgaccgggtgacgcagctgccgtggccgcagagctaccgcatccagactgcgctggcccagtccgagatggagctgcacgcggcccgcagcggggtgttcgccagcctggagcggcagtgggaaaagctgtcggccggacagccgctgagcaccggggagcgggtttcggccgcgctggcgcgccaccacgccttcggcaccgcgcgcgccatcgtcgccaggttgttcgacaccgtgggcggcgccgccatataccgcgccagctcgccgctggatcgctggctgcgcgacaccaacaccatgtgccagcacgcggtggcgcaggacatgattttgcagacatgcggcgaattgatgctgggcggccagccggacaatccgttcctgtaagcgagccggcgcgggcggcgctgttccgcccgctctcccattttcttgtttggagcagacctgatgcaagacaacaccgacaacgatctgtcggcgcgacgcgccgacggccccggccacgcctacctgcctgccggcagcggccagcgcgtgtggatgagcggggacgagtaccggattttgctggatgccgcccacagcgccggaaccatgaccttgctggacgcgctggtgccgccggcgggcgggccgccggagcacgcccacgccgatgtcgacgagctgttcgtcgtgctggacggcgagctggagatcatggccgacggcgcgaagtaccaggtggggccgggggggcgcgtgttcgtccggcgcggcacgccgcatgccttccacaaccgcagcgcagacccggtgcggatgctgattttctataccccggcgggcgtggaggagttcttcctggcggccggggtgccggcccaggacggcttgccgccgccgccggcggatgaggaaagcaccgcgcgggcgatcgaggcgggattgcgtttccaggtgtcgcaagcggcgcagcccgcctgagcattgacttgaataaagaaaggtaaagccatgccattggcaatctatgtgttgggtttgagcattttcgccatgaccacgtcggagttcatggtagccgggatgatgccgtcgctggcggcgcagttcggcgtttccctgacggccatcgggtacctggtgtcggctttcgccgccagcatcgtggtgggggggcccatcctgacggtgatgctgctcaaggcgtccaagaagaacaccctgctgacgctggtggcgctgttcttcgtcagccagctgatcggcgccaccgcccacagctatgaagtgatgctggcgtcgcgggtgttgtccggcgtagccgagtcggcgttcttcggcgtctcgctggcggtgtgcgtcgacatcgtcggcccgcagcggatcggccgcgcctcctccatcgtgctgggcgggctgatggtggcgtcggtggtcggcctgcctgcggccacgctgatcgaccagcatctgggctggcgcgccagcttctggatcgtggccgggatgatgctgttctgcgggctggtgatcgcggtgcaggtgcccaaatcgccgaaggccgccgagatcagcctgaagcaggagttcgccgccttccgcaatgccgatctgtgggccgcctacggcaccagcggcctgatcatcggcgccactttcgccgccttcacctactttgcgccgattttcaccgaggtgagcggcttctccaccgctaccgtgccggcgctgttcgcctgctacggcctggccaccatcgtcggcaccatgatcaccggccgcctggccgacaagcacaccatgggcgtgctggccgtcgggctggtgatcctgatctcgctgctggcgctgttcgcgctcaaggccgaatcgcaggcggtgaccatcgtcgcggtggcgctgctgggcttggtcggcctgccgatgaatccggcgatggcgatccgcgtgatgcgcgtcgccaacaacggcccgctggtgaacaccgtgcataccgccgtcatcaatgtcggcatcgtggtgggctcctgggccggcggctcggtgatgagcgccggacacggtctgcgcgcgccgctgtgggtgggggtggcgctggccatcgccggtctggtcagcgtgctgcctttcctgcgccgtcacagcgcggaaggcgtgcgcgcaaggttggcgggcgcgacccgctgaatcgcggcatgcgccgggccgggatgctcccggcgccgggcgccgcatctgaatggaaatgaaagcaatggatacgaaattcgcagggaaggtggcgctggtgacgggagctggcagcggcctggggcgagagctggcgctggaactggcgcgacaaggcgcggcggtggtgctggccggccgcaacgaggacaagctgaaggcggtgcagaacgaaatcgaggcggccggcgcgcaggcgctgtcgcactcgaccgatatttcgctgccgcatgaggtggacgggttgttcgaggcgatacggcgccgctatggccggctcgacatcgcggtcaacaatgcggcgatctgggaaaccggcctggtggccgaacaggacgaggccgcctggcgccgcatcatcgacaccaatctgaacggcacctggcgctgcatgcgggcggagatcggcttgatgcaggaacggggcgaaggggtgatcgtcaatttgtcgtccatcgtcggcggccattttgcgatgcccggcaccgcggcttacggcgccagcaaggccggtatcgaggcgttgacgcgcacggcggccaaggagtgcatccagcagggcatccgcatcaacaccgtcagcccggcggcgctggacaccccgatgtcgctgctggagggcgaaaccgaggaggagcgcggcaagcggctgggcggcatcatccccatcggccgggtgggacgcttgtcagaggtggtgcagaccattttgtggatctgctccggcgatgcctcgttcttcgtcgggcatgactttgtcgtcgatggcggcgtgaccgcctgaccggatgccgccggaacaggccggcggcgagtccggcgcggcgtcggcagcataggcagggagaaagctatggaagtcttgaaaaagcatcacatcgaatgtgacggccaacattggcaacaagagtacaagagcacgctggggcgcttcccgaccggcgtttgcctggcggtgctggaagagggcgacgacaagatcgccatcaccatcaattcgttcagttcggtttcgctggtgccgcccatcatccagttttcgctgaagaaccattcccgcttcctgggcaaggtgcgcgacgccaggcaattcagcgtgtatttcctggcccggccccaggccgaggaggcgctgatgttcgccaagcagccggccagcccggtgtcgccgcaagtgctgggggattccgcggccgccattcactgccggctggaggacacgtatcagaaaggcgaccacaccatggtattcggcgaggtgaaggcggtcgagcatggacgcggcgacgcgcttgcctactaccggtctcatttcacatcggtagagggctacgcatcgtgacgtacttgcaatcgccgaacggcccggcgccgcgcctgccctcgttgaccggcatgcgattcgtcgcggcggcgctggtgtttctgtttcacgcctcgttgctggcagccgtcaaattcaacccttatcaggacagcggcgcggcgcagctgtttcagtccatcttcagcaaggccggctggctgggtgtgtcgttcttcttcgtgctcagcggattcgtgatgacctggtcggcgcgggcggacgactccgccggcggcttcatccggcgccgcctgctgaagatctaccccaaccatttcttcacctggctgctgatgatggtgtgcatggggaatgtgttcgtcgaccccagggtctggctcagcaatctgctgctgctgcagtcgtgggtgccgcgcccggaggtgttcatgggcgtcaacagcccgtcctggtcgctgtgctgcgagctgctgttctacctggccttcccgtggctgaaccagcgcatcgcgcgcattccggccggacggctgtggccgtgcgcggcggcggcggtgctggcgctgttcgcggtgcagctggcggtggacagctgggtgccggccacgcccaaggggccgggcctgccgatttcgctgcagcagtggtggctatcgtattttttcccgccgttgcggatgttcgagtttgtgctgggcatgctgatggcgcgcatcctgcgggccggcaaatggccggatctgggcctgctgcccgcggcgggcttgttgctgggcggttatctgctggcgcgggaagtgccgtttttgtacggactgagcacggccacggtgattccggtggccttgctgatcaccgcggcggcggcggccgacgcgcagcggcgccccaccggcttcaacggccggcgcatggtgtggctgggtgaagtgtcgtttgccttttacatggtgcatatgctggtgctggatctggctagcgcctggctggatggccgccgtttcgagcccgccgcggcgaccctggtggtgctggcggccttcctggccagcctgttggccggctggttgctgtacgcgctggtggagcggccggtgatgcggtactggagccgcccgcgcgccgccgcggtcaggctgcaatcggccgacgcctgagcgggcgacgccgcagaggcggcccgcgccaaatcaatgctaatgaaaattatttagttccggggtgcatatggataagtttttgaagggacgtgtcgcggcgtcgttgctgccgctggccgccgcgctggcattggccggctgcggcaaggatctgggcgcggcgcaagcggcggcgcaggcgccggcgcctgcggtgccggtttcggtgcagcaggtggcgccgggcaatgtcgatgtcgcgtacgagtatgtcggccagtcggccggatcgcgcgaagtggaggtgcgggcccgggtgggcggcatcttgcagaagcggatgttcaccgaggggcagccggtgcggcagggcgatccgctgttccagatcgacccggcgcctttccagatcgcgctggagcaggctgtcgccgcgctgcgcgaccggcaggccgagctgacccgcgcgcagcagaattacgaccgcgtgcagccgctgttccgcgagaacgcgctcagccgcaaggatttcgacgaggcggccgccaatcgggaagccgcccgcgcccaggtgatggcggcgcaagccaaggtgaaggaggcgcagatcaacctgggctatacccgggtgtcggcgccgatttccggcctgaccagccgcgaggtccgctccgagggcagcctggtgggcggcagcgccgacgccagcatgctgaccaagatcagccagaacgatccgatctatgtcaatttcaacgtgccggaggcggatctggacgcgctgcgcggccagcagtcgtccggcgcgctgaaattccacggcggcggcttcaaggtgtcgctgcggctgtccgatggcagccgtttcgaacgcagcggctcgctcaacttcaccgaccacctggtggacgcctccaccggcaccgtgcgcctgcgcgccagcctggccaatccggacggacggattctgccggggcagttcgtgacggtgctgctgcaaggcgcttaccgcgcccaggccatcgccattccgcaacgggcggtgctgaccagccagcaaggcaaggcggtctgggtggtgggcgcggacaaccgggtgcagctccgcccggtggaggccggacaggaacagggcctcaatgtgctgatcaacaaggggctgaaggccggcgaccgggtggcgctggacaatctggtgaagctcaggcccggcgcgctggtgcagatcagccctgagccggccgcaaccggcgcgtcttcccgcagctaatactggagcctcgcaatatgttttcctcctttttgatccgccgaccgatcttcgcctgcgtgctctcgctgatcatcatgctggcgggggtggcggcgatgggcgtgctgccggtcgagcagtacccgcagatcgtgccgccgcaagtacaggtggtggcaagctatcccggtgcctcggccgaggtgatcgccaataccgtggccgcgccgcttgagcaggcgatcaacggcgtcgacgacatgctgtacgtgcagtccatcagcgccagcaacggccagttgacgctgaacgccacgttcaagatcggcaccagtccggaccaggccaccatcaacgtcaacaaccgcgtgcagtcggcgctggcgcagctgccggaagaggtacggcgccagggcgtatcggtgcgcaagcagtctgcggcgttcctgcaggtgatcgcgctgtacgcggagaaggggcgctacgacaccctgtacatgagcaactacgcgctgctcaacgtggtggacgaactcaagcgcattcccggcgtaggcgacgtgatcaacttcgccggccgcgactattcgatgcggatctggctcaagcccgatcgtctggcgcagttgaagctgacgcccagcgacgtggtcgccgccatccgcgagcagaacgcgcagttcgccgccggcaagctgggcgccgagcccagcaaccaggcgctggactttacctacaccgtcaccacccgcgggcggatgagcacgccggaggagttttccaacatcatcgtgcgcgccaatccggacggctcggcggtattgctcaaggaggtggccaaggtggagctgggcgcgttgaactatgacttcaacggcaagatcaacggcgatccgatggcgccgatcgggattttcctggcgccgggcgccaatcagctggaaacggccaaagcggtcaaggacacgatggccaggttgtccggccgcttccccgacggtctgaaataccgcatcccgttcgattccaccaagtttgtcgaggtgtcgatcgaggaagtgtacaaaacgctggccgaagcgatggcgctggtatttctggtggtgttcctgttcctgcagaactggcgcgccacgctgatcccgtgcctggcggtgccggtgtccatcgtcggcactttcgccggcatgtacgccttcggcttctccatcaacctgttgacgctgttcggcatggtgctggccatcggcatcgtggtggacgacgccatcgtggtgctggaaaacgtcgagcgcatcatgagcgaggcgaaggtttccgccaccgaggccaccctccaggcgatgaaagaagtgtccgggccggtggtggccatcgtgctggtgttgtgctcggtattcgtgccggtggctttcctcggcggcatcgccggccagatgtacaagcagttcgccatcaccatcgccatttcggtcagcatttccggcctggtggcgctgacgctgaccccggcgctgtgcgcgctgatcctgcggccggggcaccagagccgcaatcgtttcttcgactggttcaaccgcaacttcgacgccgtgggcggccgctacgtgcgcggcgtggcgttcctgtcgaggcgcagcgcgctgggcctggcgctgttcggcctgctgttgctggtgtcggcatggctgttccgcgccatccccaccagcctggcgccggatgaggatcagggttatgtgatcgcggcggctttcttgcccgacggcgcgtccttgcagcgcaccgccaaggtgatggacaagctggaccatctggtttcgcgcaatcccgcggtgaaggacatgctgtcgatgtccggcttcgacatcgtcaccggcggcaagaagaccaatgccggcgtctccttcatccagctgcagccctgggaggaaaggcgcggcgcggcgcagtcggcgcaggcggtggtcggcgacatcttcgccaagaccggcgccggcatccgcgacggcttcattttcgcggtcaatccgccgccgatctccggcatgtccaataccggcggttttgaaggctatctgcagaaccgcaacggcgcgtcgccggccgagctggaaggcgtgtcgcggcaattcctcgccgccgcggccaagcggccggagctggccggcgtgcagaccacctattcggcgtcggtgccgcaggtgtacatcgagctgaatcgggccaaggccaaggcgctcggcgtgccgatcaacaccgtgttcgataccctgcaaagcacgctgggcgagctgtacgtcaacgacttcaacaagttcggccggactttccgcgtgcagctgcagtcggaagcctcctaccgcagccacagcgacaacctggccaaggtcttcgtgcgctccacctctggcgccatggtgccggtgacggcgctgctggacatccagcgcagcaccggtccggaagtgctggagcgctacaacctgtatccgtcggccaagctgatcggcggcccggcgccgggctacagctcgggcgaggcgctggcggcgatggagcaggtggccaaggaaacgctgcccgacggctacgcgctggcctggaccggcagcgcgctgcaggagaaggcggccggcggctcctccgccaaggtgttcctgttcggcatcgtcgtggtgttcttgatcctggcggcgcagtacgaacgctggaccctgccgctggcggtgttgctggccgtgccgttcgcggtgttcggcgcgctggtggccaactggacgcgcggcctcgccaacgacatctacttccaggtggcgctggtgacgttgatcggcttatcggccaagaacgccatcctgatcgtggaattcgcgatgctcaagctggacgagggcatggagttggtgcaggcgaccatgcaggcggcgcgcatgcgcttccgccccatcgtgatgacgtcgctggcctttgtgctgggttgcgtgccgctggccgtttccagcggcgccggctccgccagccgccactcgatcggcaccggcgtgatcggcggcatgctggccgccactttcatcgccaccttcttcattcccttgttcttcattctgatcatgaaggcattccataaaaaagccccggcggctgcggcggccgaggaggaggtgctcaatgtttaaaccgctatttctcgccgccgcgttgagcgccgccctggcggcttgcgcggcgggccccgactaccagcgccctcagctggcgttgcccgacggccaggcgcaggcggcggccgacgtggccggctggtggcggcaattccaggagccggagctggaccggctgattgccgtcgcgctggcgcgcaaccaggatctgagcgaagcggacgcccgtctggcgcaggccgaggcgctggccggcatcgcccgcagccagctgctgcccaggctggacgccgccgccgacagccagcgccagcgcgtcagcgcgacgctgcccgccacggcgccgggcggcctttacgacagccgcgatttcaatctgcgggcatcgtgggagctggacctgtggggccgcctgcggcgcgagcgcgaggcggcggtttccctcgccgccgccagccaggccagccgcgacggcctgaggctggcggtggcggcgcaggtggcgcaaacctatttccagctgcgcgcctacgatgcgcaactggaagtctcccggcgcacgctggccaaccgccgggccgccgcgacgctgaacgagaagcgcttccgccagggcgacgcgtcggaactggactggcgccaggccgaagcggaggtggcggtggccgaggccagcgccgcgcagttcgagcgcagcgtggcgcagaccgaaaccgcgctgggagtgttgctgggacgcgagcccagacagttgctgggcgagggaatcgcgcgcggccaggcgctggatgcgctgagcctgccgccggccttgccttccggcttgccgtccgacctgctggcgcgccggcccgacatcgccgccagcgaggctggcctggtggcggccaatgcccgcatcggcgtggccaaggcggcctattttcccagcatcagcctgactggcgcgctgggcagcgccagcccggatttgcgccagttgttcagcgggccggcctatgtctggagttttgccggcaacctggcggcgccggtattcaactttgggcagacggcgggagcggtggacgtggccagcgccggccagcagcaggcgttggcgcagtaccgcaaggcggtgcagctggcgttcaaggatgcggcggacgccttgagcgccatggcggcggcacggcgcgtcaacgatgcggaaaccgcgcgcgtcaaggcattgcagcgggcggtgcggctggccactttgcgctatgacagcgggcactccgcttacctggaggtgctggatgccgaacgcggcgcgttccagtccgaattgagcgcggtggatgcccggctggatctgttcaacagcgcggtggcgctctacaaggcgctgggcggaggctggcgcgcgagctaggaagcctggccgtccggcagcgcccgctcggcgagaaagtcgatcagcgcgcgcagccgggacggcatctggcggctggagctccagacgatgcggatagtgccgcttgactccatgaagtcgtccagcaccagctccagcgtgccgtccgccagcgcgtcgcgcaccgagaaatccggcacgcaggcgatgcctttgtcacgctgggccaggtagatcagcgcttcgctattggtgcagatcacggtgctgggcagcagcggggccggttcgccggggagagggcgcagcggccagcgcgccagtttgccgctgttgggaaacttgtattgcaggcaggcatggcgttgcagatcggccggccgttgcggccggccgcgctcgctcaggtagcccggcgcggcgaccagcaccaggcggaacgagcccagtcggcgcgccagcaggcgggagtccagttgctcgccggagcggatcgcggcgtcgaagccttcttcaatcaggtccaccagccggtcgctgtagtcgagatccagctcgacctccggatagaggctcatgaattcggccagcgcggggttgaacagattgccgtccggcaggctgacgcgcaaccggccgcgcggtcggtcggcgctttgcgccagctcgctttccgcggcatccagctcggcgaagatgcgctggcagcggcgcagaaacagctcgccttcggcggtcagcgccatgtgccgggtgctgcgctgcagaagccgtatgcccagcctttcctccagcctggcgatgcttttgccgactgccgaggcggagatgcccaattggcgtccggcggcgacgaagctggaggtttccgccacttgtacgaatacgtgtatcccgttgagtttttccatggtggcgttcgaattgcggacaaatttatccgcataaaatggaaatctaacatgtttttatgcttttggtcttgccttatgctggtgtgactggcaaaggccatccatgacatcgctaagaaaggaagagttatgctgactgcggaattgtccaacccggtagtgcagccgggagtgcatcaatacggtatcgccgagcggatcgacgacgccatccatcgcgcgctggccgagcagaggctggtcggcgcggtggtgctggtaagcgtcgacggcaagctgatctaccaaggcgccaagggttgggccgaccgcgaggcggaacggccgatgacggcggacgccctgttccgtttgtcttctttgagcaaggtctacgtgtccaccgcggcgctggcgatggtcgaggcgggcatcatcggcctggacgacgctgtcacccgttggctgccccattttgcgccggccttgccggatggccgcattccggaaattaccgtccggcatctgctgacgcacaccgccggtctcggctacggtttcctggagggcgagcaaggcggtccttacaagcagatgggcatttccgacggcatggaccattcggtgctgtcgctgcgggaaaatatcgaacggctgggccaagcgcctttgctggccgagccgggcagcgcctggatctattcgctggcgaccgacgtgcttggcgaagtgctggagcgcgcgacgggcagccatctgcatgaagtggtgcgcaaatgggttaccgagccgctgggcctgcaggacacccgcttcgccgccagcgattaccgccgtctgaccacggtgtacgtcaacgagcagccggcgccgcggcggatgcgcgacctggagctggtgccgattctggaaggcttccgcggcgtcagcctggccccgggccgcgcgctggatcacaacgccttcccctccggcggcgccggcatggtgggaaccgcgggtgatttcatgaccttgctggaatcgctgcgcagcggcggcggacctttattgtcggccgccatggccgcggaaatgggtcgcaaccagactggagacttgccgctggccccctggccgggccggggatatggcctgggtttcaccgtgttgaccgatccgcaggcggccaatacgccggagtcgccgggcagctggcggttggcgggggtgttcggccattcgtggtttgtcgatccggccaagcgcatcagtgtggtggcgctgaccaataccttgctggaaggcatgctggggcagtttaccgtcgatatctgcaacgcggtttacggccaggtttgagaggcgggggtttgtctgccaaaacggcccggcggcgatgccgggccgatttcgtatggccagcgcgcagggccgtgccgaccgcgtctggcttttaagtcgcatggctggacaaattaagatggcagaattgttaacgcgtattgctgagacatataatgcttttttaattcacttaattggaattttgtcgctgtgaaaacaaaattccggcccgcatcgtcatggacctcaccaacctgctgtcctccttcgcctccgccttcacccaggaccgccgccagctcaccctgcaactgggcgacggccatgtcgcggccgagcagctgctgccgcaaagcctggacggcgaggaaggcgtgtcccggccctatcgcttcaccctgacctgcctgtcgcccgacggcgccatcgcactcaagaccctgctcggtcaatccgcccntggtacgtgagctgggttcaaaacgtcgtgagacagtttggtccctatctgcagtgggcgttggaagtttgacgggggctgctcctagtacgagaggaccggagtggacgaacctctggtgtaccggttgtcacgccagtggcatcgccgggtagctaagttcggaagagataaccgctgaaagcatctaagcgggaaacttgcctgaagatgagacttccctggaggcttgacctccctgaagagtcgttcgagaccaggacgttgataggtcgggtgtggaagcgctgtgaggcgtgaagctaaccgatactaattgctcgtgaggcttgatcctatcatttgagtggcttgggaaactgagacacaagagagtggatgtgcgacgtacgtcaaataccgaatatatgcgaatctgtctgagagacgggttcgggcttctttaagtttgtacagtttatgtctggtggccatagcgaggtggtcccacgccttcccatcccgaacaggaccgtgaaacgccttagcgccgatgatagtgtggcattcgccatgtgaaagtaggacaccgccagacgccccatacagaaccccagctcgatgagctggggtttctgcgtttcggccgccgcccgtggggcggcgccgtttcggccttgccatgaaaaaccccgccagttgcctggcggggtttttgttgggcggaggcctgagatgcttacaagcctacccacttgccttgcttcagttgatacagcgataccgtcgcctgctggatgtcgcccttggcgtcgaacttcaccgggccggtgacgccctggtaatcggtcttggcgacttccggcaggtatttggccggatcggcggagccggcgcgcttcatcgccgcgattagcaccttggcggcatcgtagttgtacggcgcgtaggcctggatttcggtctggaattgctgcttgaacttctggttgaagtcggcgtagccgggcagtttttccttgggcagtccggcgctggaggcataggcgccttcggcgctgccgccgcccagtttggcgaattccggcgtgttgacgccgtcggcgcccatgaaggccgccttgatgccgagcttgcccatctgcttgaccatcgggccggcctgggcatccatgccgccgtagaacagcagatcgggcttttctcccttgatcgaggtgagcaccgccatgaagtcggtggcgctattggtggtgaactcgcgcttcaccactttgccgccggcctgttccaccgctttggcgaagtcgtccgccaggccctggccgtaggtggtgcggtcatcgatcaccgccacgcgcttggcgcccagcttgcccaccgcgtacttggccagcgcttcgccttgctgctggtcgttggcgatcaggcggaaggtgttgcgatagccttgctgggtgaaggacgggctggtgaccgagccggaaatcatcgggatgccggcgtcggagtaaatgcgggacgcggggatggccgcgccggaagtcaggtggccgacgatgccggccaccttggcgtccaccatccgctgcgcgacttgggtggctaccttgggatcggcctggtcgtcttccgacaccacttcgaagctggccggcttgccgtccagcaccagtttttcggcattggcttcctgtaccgccagcttgacgccgtcgtcggcgtcgcggccccagtgggcgaacgggccggtcagcggattggcggtgccgatcttgacgacgatcttgtcttcggcggccttgtcgttggatgaagtctggccggcaggcttgttgcaggcggcgacgccggctaccagcgcgcacagcagcaggctgtgtcgggtttgcatgatgaatctcctgatgttctctttgtttattttgatagtgtcgccaatgctatggcgtgagcttactgtgtcgattggccatgggtttgtcaatcggcgcggcggcagcatctgccgcgaatgcggccgcccacgtcgtggaatgcgcgcagacgcgcggattcgacgatttcgtaacgcgcgcgccggcatgaaaaaagcccgccggagagggcgggcttggatggcgcgggcgaggcttattgcggtttgggcgcttgccagccgccgcccagcgccttgtacacgcctatcgtggtattgaggcggtccagcttggcgctgaccaggttcagctcggcttggaagctgttgcgctgcgcgtccagcacgtccagatagctggagtagccgttgtcgtagcgcaggccggccagtttcagcgtgcggttgagcgcggcgagctgggtggtttgcgcctgcacgatgtcgcgcgcggcgctgttggcggccagcgagtccagcgcgtccttgaacgccgactgcaccgacttctggtactgcgccagcgcctgcttctgcccggcgctggcggcatccacgccatagccggtggcgccgaagttgaagatcggcgcggccaggttggcggcgaagccccaggtgcgggccgggccggtgaacaggccgtccagcgacaggctttgcgagcccaacgccccggtcaggttgatgctggggaagtaggcggccttggccacgccgatgcgggcgttggcggcgatcagctgctgctcgctggaggcgacgtcggggcggcgctccagcaggctggccggcaggtcggccggcacgtcgggcgggctggccaggctgttgatgtccttgccgcgcgtgagatcgccgctggccagctgtttggggctgtggcccagcagcacgcccagcgcggtttcggtctgttccagcgagcgggcgatctgcggcaccgaggcgcgcgccgcggcggcttccgcttcggcctggcgctggtccagctcggaaatcaggcctccgtgaaagcgcttggtctgcagtttcagcgattcctcgcggctttgcagcgtgcgtttggcgatgtccagctgggcgtccagcgcccgcagctggaagtaggtttgcgctacctgggccgtcagcgccagctgggcggcgtcgcggtcgtagcggctggcgatgtagccggcgcgcgccgcttcgttgctgcggcgcagcttgccccacaggtccagttcccaggcggcggtcaggttggccgcgcgcacgtcgttgaccagcggggtgccggggctggtggtgagggccgaggtgcggccgctctggtagccggcattggcgccgagcgagggcagcagcgccgcgcgggcgatgccggcctgggcggcggcctgttcgacgcgggcggcggcggcctgcaggtcgaggttgctcttcacggcctcctcgatcagctggttcagcgccgggtcgtcgaaacgctgccaccagtcggcgtccagcgccggcgcttgggcgccggcctgggccgcgggcagctcgaccttgggccggctgtagtcgggaccgaccgcgcaggcggatacggccagcgcgacggcgacgggaatcagggcgcgcttaagcatctgagttctctcctgcctcaaccgccggttgaggttttttcttgccgaacttcatgatcaggatgaagaacagcgggatgaagaaggtggcgatgaaggtggcggccagcatgccgccgatcacgccggtgccgatcgagtggcggctggcggagccggcgccgctggaaatggccagcggcacgcaacccagcacgaaggcgagcgaggtcatcacgatgggacggaagcgcagccgggccgcttccagcgccgcttccatcgcctccatgccttcttccatcttctgcaccgcgaactccacgatcaggatggcgttcttggccgacaggccgatcagcgtcaccagcgccacctggaagtacacgtcgttggccaggccgcgcagccagttggccatcagcgcgccgaacaccgcgaacggcaccgccatcagcaccgagatcggcaggctccagcgctcgtactgcgccgccaggatcaggaacaccatgatcatgccgaagccgaacaccagggcggacgagccgctggtggacttttcctggaaggccgagccggtccaggccaggctatagcccgcgggcagcgtttccttggcgacttcctccagcgcggtcagcgcctggcccgagctgtagcccggcgccgggccgcccaccagcttcgccgccgggaacacgttgaagcgttccagcgtttccgggccggtggtttgctggatgttcaccagcgcggtcagcgggatcatctggccggtctgcgagcgcacgtagacgttgcgcaggtcgtccaccttggtgcggaacggcgcctccgactgcagctgcacgcggaaggtgcggccgaacttgttgaagtcgttcacgtacagcgcgccgaaggtgctctgcatggtgtcgaacacgctgttgatcggcacgcccagcgccttggccttgtcgcggtccagttggacgaagacttgcggcacgctggcggagaaggtggtttgcacgcccttcagttccggccgtttggcggcggcggccaccattttcttggtgacttcgcccagcgcggtcggggtgccgccggcgcggtcctgcacataggcttcgaagccgccggtgttggacatgccggagatcggcggcgggttgaaggccagcacgatgccgtcgctgatgcccatcatgcccttgccgaacacgtccttgaccacggcttgcgccgacagctgcggatctttgcgttgatcccagggcttgagcacgatgaaggacacgccggcgttggtcttgttgccgccggacaggatgtcgaagccggcgaaagtcatccggtcctgcaccgccgggttcttggccatcatggcatccagcttgtccatgctggcggcggtgcgggtcagcgacgcgccgtcaggcaggaaggctgcggccaggatgtagccctggtcctcgtccggcgccaggctggacggaatgatgcggaacaggccggcggaggcggcgatcaggccgccgaacagcagcaccgccagcatggcgcgcttgttgatgaaggccacgccgttggtgtagcggctggtcaggcggtcgaaccaattgttgaaccaggtgaagaagcggttcgggtgctggtgctcggccttcaggatcagcgcgcacagcgccggagtcagcgtcagcgcgacgatgccggaaatcaccaccgataccgcgatggtcatggcgaactgcttgtacatctggccggcgatgccgcccaggaaggccaccgggatgaataccgagcacagcaccagcacgatggccaccagcgcgccggacacttcctgcatcgctttcaggctggcctcgcgcggcgacaagccttcctgcgtcatcaggcgctcgacgttttccagcaccacgatggcgtcgtccaccacgatgccgatggccagcaccaggccgaacagcgtcagcgtgttgatggtgaagccgaacgcgtacatgccggcgaaggcgccgacgatggacaccggcaccgccaggcagggaatcagcgtggcgcgccagttctgcaggaacaggaacaccaccaggaataccagcaccatggcttcggccagcgtcttgtacacctcttcgatcgatacttcgacgaacttggtggtgtcgtacgggatgccgtaggacaggccggtcgggaagctcttggacaggcgcagcatttcggtttccaccgcctgcgcggtggccagctggttggcgcccggcgccaggaagatgccgatcgggatggtggccttgccgttgtgcttgccgtggaagtcataggacagcgcgcccagctcgacgcgggccacatccttcagcttcaccgcggagccgtccggattggcgcgcacgatgatgttttcgaactcttccggctcggacaggcggcccttggtggtcaccgtgtaggtgaagtccagcttctgcggcgtcggttcggcgcccagcttgccggcggcgaactgcgagttctgctcgcggatggcggcggccacgtcgctgggggtcagcttcagctgcgccagcttgtccggcttcagccaaatccgcatcgagtagtcctggccggcgaagttgaccacatcgcccacgccctgcacccgcttcagctcgtccaccacgttgagcagcgcgtagttgctgatgaacagcgtgtcatggctgttgtcgggcgagaacagcgacaccacctgcaagatggtggccgatttcttgcggacgttgacgccctggcggcgcacctcctccggcagctgcgacagcaccgactgcacgcggttgttgacgttgatggtcgcctggtcggggttggtgccgatcttgaacgacacggtcagcgacagcgtgccgttgctggcgctgttggactgcacgtagagcatgtcgtccacgccgttgatcgcctgttccagcggcgcggccacggtgttggcgatcacttcggcggaagcgcccggatagctggcggtgacgttcaccaccggcggcacgatttcagggtactgctggatgggcagcgccttgatggcggccaggcccgccagcatgatcacgatcgagatcacgctggcgaagatgggtcgccggatgaagaaagcggaaaacataaatcagattccccctgcgattactgggccgctgccgcgggcgcgctggcgtccgcctggaacggatgcggtttcacgtcggcgcccgggcgcagcttgatgatgttgtcgactaccacctggtcgccggccttcaggccctgctcgaccagcacgctcaggccgacttcctgcgataccgtgatcgggcgcggctgcgccttgccttccggccccaccacccacaccatcttgccttgctgggtggtcagcaccgcccgctgcggcacggtgatggcggcggtgcgcaccgcgccgttcagctgcacgcggacgaactggccgggcaggatgccgccttgcggattggcgaagctggcgcgcgaacggatggtgccggtattggtgtcgaccaggctgtcggtgaagttcaggtggccggtcttgccgtagacgctgccgtccggcagcttcagctgcacttcgaagccgccgccattggccagcttcagcttgccggcgtgctgcatcttgcgcagcgccagcatgtcgccgtcggacatgctgaagttgacgtagatcgggtccagctgcgagatcttggtcaagaggctggcgtcggcgctggtggccaccaggctgccctcggagcgggcttcctggctggtgatgccggaaatcggtgcggtgacgcgggtgtagcccagattgatctgcgcctgctccagttgcgcctgggcggaggccacttgcgccttggcggcgttgaaggcggccaccgcgtcgtcgcggtctttctggctgacggcgttttccttgaacagcggcattacccggtcgtagtcctgcttggtgcgcagcaattgcgcctgctgcacctgcagattgcccttggcctggtccagcgccgccttgaacggctccggatcgatctggaacagcaggtcgccggccttcaccggtttgccttcggcgtaagcgcgtttttgcaggatgccgccgacgcgggcgcgcacctcgacttcgcgcgagccggccgcctggccgacgaattcatacgataccggcacgtcggccggttcgaccttgatcacggccaccggcaccggcggcatggcgccggccttggcgtcgggcttttgtccgcaggcggccaggctggctgccagcgcgcccaacagcaggccgcgcgcggcgcgcgggagagttgcagttccttgcatggtatcgaatcctcgaaagcaaaatcgggaaggtaatcaaatggatagggcttcaggggatggtcagtctggattgtcataacctgaagcttcggtattttacatacatacgcgtctgtatgtaaaatgctataatgtctcggatatgtaaaaacgcagcggtttgggcaacaaagaaccgttaaaattcatactagtactaagagcgaagaatgatggatggcacggaaaacacgtgaagaggccgagcagacccgccagctgctgctggatgccgccgagcggctgttcagcgagcagggcgtgtcgcgcacctcgctggcggaaatcgccaccgcggcgggtctgacccgcggcgcggtgtactggcatttccagaacaagctggacctgtaccgcgcgatgctggaccgggtttcgccgtctttcgacgatatgcgcgagcaactgttgcgaaccgccgacaccgatccggcgcgggcgctgtgggagcacagccaccgcctgctggcgctgatcgagcataatcctcaggtgcggcgcatcctgctgatcctgtttttgcgcagcgagcacgtcggcgagctagagcctatccacgaggagtgcgtggcgcacatgcacgaggcgcgcggcttgctgagccatgtggtgcaggtggccaaggacagggggcaggcgtatgcctgcgtcgagccggaagaggcggcgacggtggtgcaggcgctgcacgacggcctgatgcacaagctggtgatagagcagccggggccggacgccatgctggcggccagccgcttgttgcaatatttgtaccgcggcatcttcacgcctgaaatcatggaacaacttaccacctgagcgcgcggcggcgctataattgcgcttttttctcaagccactagcgcagccgtcttggtctggcatcgccttggtggcgccatggttttcatgtcccacgcaatcgaaatcgaggccgtcagcaaacgctacggccagctgcaggcgctggataaggtgagcttcaccgtcgagcccggcgaattcttcgcgctgctcggccccaacggcgccggcaagaccacgctgatctcggcgctggccggcttggcgcgccccgacagcggccgcatccgggtgatgggccacgacgtggtgcgcgatttcaagcaagcgcggcgcgccctgggcgtggtgccgcaggagctggtgttcgaccccttcctgtcggtgcgcgaaacgctgcgcttccaatcgggctacttcggcctgtcccgcaacgacgcctggatcgacgagctgctgttcaaactgggcctggccgacaaggccgacagcaatatgcgcgcgctgtccggcggcatgaagcgccgcgtgatggtggcgcaggcgctggtgcaccgtccgccggtgatcgtgctggacgaacccaccgccggcgtcgacgtcgagctgcgccagagcctgtgggtgttcgtgcaggagctgaaccgcgccggccacgccatcgtgctgaccacccattacctggaagaagccgaaacgctgtgctcgcgcatcgccatgctgaagaagggcaagctgctggcgctggaaagcaaggacaagctgctggcccacagcgcgcgccgcgaagtggcggtgaagctgtccggcgcgctgcccgacagcctgctgccgcgcaagctgcgcgacgaggatggccgggtggtgctgcaactggccgagctggccgaactggaaacggtgctggccaccttgcgccaggccggcgtcgacgtgcgcgaattgaacgtggtggaggcggacctggaaagcgtgttcgtcaagatgatgaacgggagcgcggcatgataggttttctcaccctgttcaagaaggagctggtgcgtttctggaaggtatcgttccagaccgtggccgccccggtgctgaccgcgctgatgtaccagctgatcttcgcccacgtgctgtccaagcacgtcgaggcctatcccggcgtcggctacaccgcttttctgattcccggcctggcgatgatgtcgatggcgcagaacgccttcgccaacagctcctccagcctgatccagtccaagatcaccggcaacatcgtgttcctgatgctgccgccgctgaccgcgccggagttcttccttgcctacctgctggcctcggtggtgcgcggcctggcggtgggcgccggcgtgctgctggtcaccgcctggttcggcctgccgttgccggcccagccgctgtgggcggtgctgttcgcggtgctgggctgcggcgtgctgggcacgctgggcgtgatcgccggcatctgggcggagaaattcgaccagctggccgccttccagaatttcctgatcatgccgctgactttcctgtccggcgtgttctattccatcaacagcctgccgtcgttctggtacgccgtgtcgcacgccaacccggtgttctacatgatagacggcttccgctacggctttttcggccaggccgacgtcagcccctggctgtccgccggcgtggtgggcggcagcttcgccgcgctggtgtctttggccctatggctgatccactccggctacaagctgcgccactgaacattattcgctctggattcccgcaatgaccgaacagcaagtcaagcaatacatcgaggccggcctcgaatgcacttacctgaaagtggagggcgacggccaccacttctacgccaccgtggtttcggccgccttcgagggcaagcgcctgatcgaccgccaccgcatggtgaaggaagtgatcgccgcccgcctggccagcaacgaaatccacgcgctctccatcgtcaaggcggccacgccggacgagtgggccaaactgcaagcttgaaagccacaccatggataaactgaaaatcatcggcaacggcccgctcaacggcgaaatccgcgtctccggcgccaagaacgccgcgctgcccattctgtgcgccagcctgctgaccggcgacaccatgcgtttcaccaacgtgccgatgctgcgcgacatcgccaccacccagaagctgctgcagggcatgggcgtgcgggtgatgaccgacaatgtccacgagatggagatcaccgccggccagctggacagcctggtggcgccgtacgatctggtgaagaccatgcgcgcgtccatcctggtgctgggcccgacgctggcgcgcttcggcgaagccacggtcagcttgcccggcggctgcgcgatcggcagccgtccggtcgaccagcacatcaagggcctggtggcgatgggcgccgaggtgtcgatcgagcacggttacgtgaaggcgcgcgccaagcgcctgcgcggcgcccgcgtggtgatggacatggtcaccgttggcggcaccgagaacctgctgatggccgccaccctggccgaaggcaccaccgtgctggaaaacgccgcccgcgagccggaagtgaccgacctggcccactgcctggtggcgatgggcgccaagatctccggcatcggcaccgaccgcctggtgatcgagggcgtcgagcgcctgcacggcgccgactactcggtgatgccggaccgcatcgaggccggcaccttcctggtggcaggcgcgatgacccgcggccacgtggtgctgaagaacgccgcgcccaagagcatggaagcggtgctggacaagctgcaggaaaccggcgcgctgatcgagtgcggcgacgactggatctcgctggacatgaagcagcgtccgaaggccgtcaacttccgcacgctgccgtacccggccttcccgaccgacatgcaggcgcagctgatgacgctgaactgcgtggccgaaggcgccggcgtggtgaccgagactatcttcgagaaccgcttcatgcacgtgccggaactgaaccgcatgggcgccaacatcgaagtggaaggcaacaccgccatcgtcaagggcgtggacaagctgtccggcgccaccgtgatggccaccgacctgcgcgcctccgccagcctggtgatcgccggcctggtggcggaaggcgaaaccatcgtcgaccggatctaccacctcgaccgcggctacgagcatatcgagaagaagctgggcgccgtcggcgcgctgatcgaacgcatcagctgatccgccccattcgcgcagacgaaaaaacgccgcctccatcgggagcgcggcgtttttctttgcccggagccgggcgggcggcggactcaggctttcttgacgaattccgacttcaggcccatcgcgccgatgccgtcgatcttgcagtcgatgtcgtggtcgccgtccaccaggcggatgttcttgaccttggtgccgaccttgaccaccagcgacgagcctttgaccttcagatccttgatcacggtgacgctgtcgccgtcctgcagcgtgttgccgaccgcgtcgcgcaccacgcgctgttcctcggctggcgcggcgctttgctcgttccattcgtgcgcgcactcggggcacacgaacatcgcgccgtcctggtaggtgtattccgatccgcattgcgggcaggcgggcaattgactcatggtgtttcctgacaaattgagaatgaaaacggccgccaggctgcgcttggcgccagggcggccggggtattgtaaccctactcgcgccatggccgcttgcccgcgcacggatgccgcgcgccaggcggcaaaaaaaacgcgccgcccacagggcgacgcgctggtccggtcgacggcggccttactgggcggcggaggccgcggccggcgccgaactctccaccgcatgcgcggccggcgcggagctgtcgctcttgccgcccggtcccggcgagtccatcagttcgtccaggttcaggttgtcggccggctgggtcggatccggctgtcccagctgcttggcgcgcagctgcatgtagacgtcgcgggtgtagctgtagcggtccaccgcggcggtgtccagcaagccgtccacgcccagatacttggcgcgggtgctgacgccgtagacgccgtagaaggcgatggcctcccggctgttgtggtagaccagccgctccgggccggggccggccagcgacgcgcccaggccggcgctgtcgcgcacggtggacgggccgaagaagggcagcacgaagtagttgctgctcttccagccccaggtggccagcgtgtcgcccagcgtggtcttgttgttcttcaggccagcctggtcggcgatgtcgatcaggccgaacaagccgaagctggagttgatcgccacgcgcatgaagtcgttggcggctttttccggctcggcgcgcagcacgttgaaggcgaagctgtagacatccttcaggttgtcgaagaagttgccgacgccggtgcgcaccggcgagggcaccactttctggtagccctgggccagcgggcgcagcacccactggtcggcggtgtcgttgaccttgaacatcgtgcggttgtaaggctcgtacgggtcgtacggcgtggccggcgcgctggcgcagccggccagcagcagaatggcgactaggggcaggatgcggcgcatttcactctccggcggatagcagggggcccagatcgtacaggccggccagggtggccagacccgccggcatgccggcgaaggtcagcgcgtggccggcggcggcggcggcgcggcgcgcctgcagcagcagcgccagcgccgacgagtcggccgcctcgatgccggacaggtccagccgcagcggaccgcgcgccgccagctcggccagcgcgcgcgccagtccggcgctggccgccatgtcgatgcgcccgctgaggctggcctcgccgggggcggtggtcttcagcatcagggtttgcccttgccggcagcggcagcggcggcggccggggtggcgttcttgtcctgcagcagcttgatcaggccgttcacgccggttttctggatttcttcgttgaagctgttgcggtagacggtgaccaggctggcgccttcgacgctgacgttgtagatcttccagcccttgtcgcccttgtacatcacgtaatccaccgacactgggttggcgttgcccggcagggtgacgctggtcttgacggtggtgtcgcggccgttggcggacagggccgggttggccttcacgtcgacctgggcggccttgaagcgggtcatggtggtggagtaggtgcgcaccagcagggtctggaactgctgggtcagctgggtgcgctgctccggggtggcctggcgccagcccaggccgaccgccagcgcggtcatgcgcgggaaatcgaacagcggcacggcggcggcttcggcctgctggcgcacctgcttggtgttcttgccgttgtcctgcttcaggatgtccagcacctggcgcgaaccgtccttgatgatttcaaccggggagtcggcggcggcgatggcctgggtggacgacaggccgacgatcagacagaacagggtaaacagttttttcatttgcaagattccatgtttcacagttcatgcggagcagagcggcggccagcgccggccgcggatgcccgcgtggagggttgcccgcttgcgacgctatttgcttgcgtctttgccggaaaatccggtcatgaatttaccgatcaactgctccagcaccatcgccgacgaggtgatggtgatggtgccgccggcggccagggtggtttccgagccgccctgctgcaggccgatgtattgctcgcccaacaggccggaggtcaggatggaggcgctgacgtcgtcgctgagctggtaggtcttgtcgatgttcagcgcgacgcgggcgcggtaggttttcgggtccaggcggatgtcggccacgcggcccaccagcacgcccgcctccttgaccggcgcttttaccttcaagccgccgacgttgtcgaagtcggcgtagacgacgtaggtttgcgacgcgctctgcggcgtcaggttggccactttcagcgacaggaaggcgacggcggcgatgcccagagcaacaaagatgccgacccataaatcaatggtagagcgtttcattcggtttttttcctagaacatgaaggcggtcagcacgaaatccagcgccaggatcaccaaggccgatgtgaccacggtgcgggtggtggcggccgacacgccggcggcggtcggggtggcgtcgtagccttcgaacacggcgatcagcgtgatggcgacgccgaagcacaggctcttgatcaggccgttgatcacgtcgtagtgcaggtcgacattgccctgcatctgcgaccagaaggtgccggcgtccaggcctatcatcaccacgcccaccagatagccgccgaacacgccgacgacgttgaacagcgcggccaggatgggcatggagatcacgccggcccagaagcgcggcgcgatcacccgcgccatcgggttgaccgccatcacgctcatcgcgtccagctgctcggtggtcttcatcaggccgatttcggcggtcatcgcgctgccggcgcggctggcgaacaacagcgcggccagcaccgggcccagctcgcgcagcagcgccagcgccaccatcgcgcccagcgcgtcggcggagccgaacttggccagcgtggtgtagccctgcaggcccagcaccatgccgacgaacaggccggagacgacgatgatgatcagcgacatcacgccggcgaagtagatctcgcgtatggtcagctgcagcctgagcaggctctggccgctgttgagcaggatggcggccaggaagcgggcggcgaagcccagccgccataccgcgttgatggtggcgtggccgagccggcgcagcggcgaagtcaggaaatcaagcatgcgcgcccccttgcagccccaggtcggcggccagcgagctggccgccggatagttgtaatgcacagggccgtcggcctcgccgttgatgaactgcgtcacccacggcgaatcggagttgcggacttcgtccggcgagccctgggcgatgatctggccattggcgacgaacagcacgtggtcgacgatggccagcgactggtgcacgtcgtgcgtcaccatcaccgcggtggtgccgagcgcgtcgttgagtttcttgatcaacagcgcgatcacgccgagcgagatcgggtcgagcccggtgaacggctcgtcgtacagcatcagctgcgggtcgagcgcgatggcgcgcgccagcgccacccggcgcgccatgccgccggacagttcggccggcatcagcttctgggtgccgcgcaggcccaccgcctccagtttcatggtgacgaggtcgcggatcatgttttccggcagcttggtgtgctcgcgcagcgggaaggcgacgttgtcggcgaccgacaggtcggtgaacagcgcgccgaactggaacagcatgcccatgcggcggcggtgctggtacagctcggcttggctcatcctggcgatgtcgcggccgtctatcagcacttcgcccgcttgcgggcggatttggccggaaatcagcctgagcagggtggtcttgccgctgccgctgccgcccatgatggccaccagcttgccgcgcggcacgcccaaggtgagatctttcaggatgggccggtcgccgtaggcgaagctgacgttcctgaattcgatgaaatggtctgaggacacgaaaattccaaactgcttgcaagaggagtcttgttgagaccccggtgagacggcgaaattcacgcgagcttcaccgcagcggcagagcggagccgcgacacgggtgaggaggggccgccactctgcggtgccgggcgggcagcttggggggtggcgcgccatccagtctcgaatagctggattttatagcgttgcgggcgtgccgccaaatatcgctatgttactgagtgcaaatttgccgcagcgcaatgcgtttgtcttgacttgagagtcaagttatttgccttaaaaccgcgccggacaagcgccggcgcggccagccacggttcagacgccgcgcaacagttcgttgatgctggtcttgctgcgggtttgcgcgtccacctttttgacgatcaccgcgcagtacaggctgtggctgccatccttggacggcaggttgccggacaccaccaccgagcccggcggcacgcggccgtacatcacttcgccggtttcgcggtcgtagatcttggtggattggccgatgtagacgcccatcgagattaccgagccttcgccgacgatcacgccttcgacgatttccgagcgcgcgccgatgaagcagttgtcttcgatgatggtcgggttggcctgcagcggctccagcacgccgccgatgccgacgccgccggacaggtgcacattcttgccgatctgggcgcaggaaccgacggtggcccaggtgtccaccatcgctccttcgtcgacgtaggcgccgatattgacgtaggacggcatcagcacggtgttcttggcgatgaagctgcccttgcgcgccaccgcgcccggcaccacgcggaagccggcttcctggaagcgggcctggttccagtcgcagaacttggtgtccaccttgtcgaagtagcgcgacacgccgtcgtcttgcaccgcgttgtcgcggatgcggaacgacagcagcacggccttcttcacccactggttgaccacccagtcggcgccttgcttctcggcgacgcgcaggcggccgctgtccagctcggcgatcacttggtctatcgccgccttcagttccgccgacacggtggcgggggtgatttcggcgcggttctcgaatgcctgttcgatcaggctttggatcggatgcatctggttcagtcctttggcaatgtggatggatgtcgtcattatttgatcttgtctgtcgggttgcggtgtttcacgccgtcagggcggcggattgcgtacggcagaattctacaattctttgcgcggcggccacgcattcatcttggccggctaccaaggcgatgcggatgtagccgcggccggggttggcgccatgggcgtcgcgggccaggaagctgccgggcagcaccgtcacgtgttgctgctggaacagcgcgagggcgaaggcggcgtcgtcgccgcccggcaccttggcccacaggtagaagccggcctccggcatttccacctccagcaccggcgagagcagcggcagcaccgcggcgaacttggcggcgtaggcggcccggttggactcgacgtgcgcttcgtcgttccaggcggcctggctggcggcctgcaccgtcaggctcatcgcgctgccgtgataggtgcggtaaagcaggaatttttccaggatggccgcgtcgccggcgacgaagccggagcgcatgccgggcacgttggagcgcttggacaggctggtcagcatcaccagccgctccaaagagcggccggacagccgcgcggcggacaggccgcccagcggcggcgcgtcgaaatagatttcggaatagcattcgtcgctggcgatgacgaagccgtaacggtcggacagcgcgaacagcttttgccagtcggccagacccatcaccgcgccggtgggattgcccgggctgcagacgatgagcagctgggcacggcgccagatttcgtccggcacgctgtcccagtcgggctggaagcggtttcgcgcctcgcagttcaggtaatggggctcggcccccgccagcagtgccgcgccttcgtaaatctggtaaaacggattgggagagaccactaccggtttcgcgccgccgtcggcgtctatcaggcattgcgtcagcgaaaacagcgcctcgcggctgccgttgaccggcagcacctggcgcaccgggtccagcgcgacgccgtagcggcgccccgcccagtcggcgcaggcctggcgcagcgccggcgagccctgcgtggccgggtagccggacaggccggacaggttggcgcacagcgcgtccttcaccagctgcggcgccgggtgcttgggttcgcccatcgccaggctgacgtggggcagttcggccggcgggcggcaatcagccagcagcgcggccaggcgctggaacggataaggatgcagttgggccaggcgtgggttcaacgcggcgtctccatgaaattcggcacgggcaatcaatcatcttaagaacagccatgacacctgtaaaacaaaaatttctcgccacctccggcatcctcaccaccgcgctggtgtgggcgctgatgtggtatccgtttcgcagcctgaaggccagcggcgtcagcgtgccgatggcttcgctggccacctatctgatcaccatcgcggtcggcgtcacggtgtttttcaaggtctaccgccgcgagttccggctggagccgccgctgctgctgctgatgctggtgttcggctggtgcaatttcagctacaccatggcggtggcggaagggaaggtgatgcgggtgctgctgctgttctacctgtcgccgctgtggaccgcgctgctgtcgcggttgctgctgcatgaaaggctgacgcgcagcggctggatggtggtggcgctgtcgctgctcggctgtttcgtgttcatctaccggccggggctgctggcgggcgagctgccgctgacccactcctacgagtggctggcgctgtccggcggcctagccttcgccttcggcaacgtggtcagccgcaagctgcacaccattccggtggcggtgaagtcggccaccatctggttcggggtggcgctgatcggcgcggtcagcctgctgcgcagcggcgaattgcacaggatgctggaaatcccggccgagagctggctgatcctggccattctgggcgtggtgctgctgtgcaccagcgtgatctcgcaacacgggctgtccatcctgccggcgacgcaggcgatgacgctgatgctgatggagctggtgttcgccgcggtgtcggcctacttgctggctggcgaggcgatgagcatgcaggaatggctgggcggcgcgctgatcgccggcgccagcctgttgtccggcgacatgacgcatccggcgccgcaccctcaccaccatcctccgtcgcagccggcggcgtgacggccacccgggaggcaaaatgctgatcaggcggatgacgccggccgatttctcggcgttctggccgatattccgcgacatcgtcgcggcgcaagagacttacgctttcgacccggcgatgggagaggcggcggcgcgggcgctgtggtgcgaggcgccgctggaaacctggctggccgaagaggacggcgcggttctcggcagctattttctgaaagccaacgccgccgggcccggcggccatgtcggcaactgcggctatatggtgtcgccggcggcgcgcggcaagggcgtggcgcgggcgatgtgcgagcactcgcagcggcgcgcgcgcgaacgcggttttctggcgctgcagttcaacagcgtggtggccagcaacgcggcggcggtggcgctgtggagcaagctgggcttcgagacggtcggccgcttgccgcgcgcctatcgccacgccgttcatggtttggtggactgcctggtgatgtacaagtggctgggcgaggcggaatagcctagccggccagcttgataggccagcatgccgcgcgtatgggccagtgtccaagaagatggcgagcggcgtgccgcgcttgaaacagaaaggcccgggcatgccgggccatattgcgacggatcagctcagccgccgcagtgggtgatggcttcgctgccgacgtttagtggtcttcccaccatttctgcgcggcggcgcgatcaaacggcggcaggatggctttgtggatggtttggtcggcgaggcccgggaagcgtttgcggaacttggcttcatcggtttcccacgcgtcctggatcgccacgtcgaatgtgccgccggaggcgccggtagcggcttggtcgatcagcgggatcggcgggccggcgcggaattcatttccctggcgttcgcggacgtccgcctgcacatggccaaggtaatacaggcctggctcgttggcattgagttcttgatgcagcgggataaagaaattgccgatgacaataaaggcattggccatcgcagtcatgccgcgaagattatatttgcctttgtccagctcgaagcgaagcaaataggaatgcccgtcttttgccgcgtcatttttatttttcgccagttcatccatcacgaaattgattcggtccgccgaggtggcgccgccatttttttcaaaatgggtcaccagcagatcgggttggaaggatggcttgtacgcatttttgatggtggccgtcatcaaatataccgctttatcctgggatggcttggctgcggggttttccgacatggccatcttggtcggagtcgcgcatcctgtcagcaatgcggctaaaagaacagcggcgggaacggctaattttttccacagcatgggtatttccttgcgtctcacggagcgagagttgttattttaagaagcgcgcgcccaatgactcatacagtcaatttatcttaatgggatgcattgaagagggagttaattcaacatgtatggacatggttcggcatgcggcgcggcattttgccagtccatgtttggaaatgcacggattaaatgaattcatgtttcaggcatgaattatttctttggaaatgcgaaaagactcgccgcccgctattggaaacgggcggcgagcgagcggcggttacagctgttgcagatactgttgcagcgccttgatattggcatcgtaggcgctgggcgcgcccagttcgacgccgccgctgcgcacgtagtaggcgaaggccacgccgcgggtgtcgaagaacggcaggaagtcgtccggctgcagcgtggtgccgttcaggccgatcgcccagttattggccttgtagcggttcagctgttctatcacgccgtggacggcgatgccttccgagctgcggatcaggccgacataatggttcagcgtgtcggtattgatctggtaggcggccggctcgccgacgctgacgccctgggcgcgcacgtagtagctgaacggcagctggcgctcggtgaagaaggccaggaagctgtccggcgccaggttgtcgccgttcaggccgatggcccaattcttggactgatactccttcaattgcttgaccacgccgtcgacggcttcgatttcctgtttggccgggacattgactgcgatggggtgtgccatgtcgtgctcctgagaagagtgggaatcaacagcaggctgcgcggcgcgcggcgaagttggacgtcatggtttgcccctgggtggattggcgcgatgaagcgcggcggtacaaggccagagtagctggggagggacgacggcgatagtgggcggagggacagcggccaaacgggagtatttgcgctataaatacttttaaaatcaatggtttgttatcggcatttcgaattagcaattgcggttttcagatgaggcgcgccgccgggtccgccagcaggcgctcaatctgccgcgcccgttcttcccgccccatttgccggtacatgtccagccagccgcgcagcggacaccagggcaggccgccgcgccagcggatggcgtcctgccggaacggatgatcatgaatgccgtcggtcgagcggatgcgcagcccggccatcaggtctatctgcaggccgtccggggtttcgaaacgggcgaagcgcgcggtggcgaagcgaggatggggagccggggtgatgtcgcgcgcccgcgccgccagcgcgcggtaggcggcgggaaaggccgcctcgctgcagacgaggtccaggtcgcgcggttgcagcgcgaggccggcttccgccagcagcgtgctgccgcctatcgcccagccgcaatcgcccagcggcggccggatggcgcgggcgaagtctgcggatgctgggccatcgccgggcgctcagtagtgcggcggaatctcgtggccgccgccggcgccgttgtccggctggctgctgcgcagctgctggtacagcagccgcatctgctgttgcagcaattccatttccttttgctggcgcgccacggtggcgttcagcgcgtccagcagctcgtcctggaacgccagcttcacttccagctcggccaggcgggtgtcgatatcggtatccatggcgcctattctacaacaccatcgccgcgatccagccggccgccatcaagggcaggttgaagtgcaggaaggtggggatcaccgtgtcgcggatgtggtcgtgctggccgtccaggttcaggccggaagtcggccccatggtggagtcggatgccggcgagccggcgtcgcccaaggcgccggcggtgccgatgatggacacggtggccagcggcgaaaagcccaggtgcgcgcacagcggcacgtagatggcggtgaggatgggcacggtggagaacgacgagcctatgcccagcgtcaccgtcatgccgatggccagcatcgccagcgccgccagcgggcgctggccttcgaacagcgcggcgccggccttgaccagcggggcgatctcgccggtggcgcgcagcacttcggcgaagccttgcgaggtgatcatggtgaagcccaccatcgccatcatcttcatgccttcgttgaacacgccgtcggcgtccttccacttgaccaccccggtggcgaggaacagcaggaagccggccagcgcgcccatgatcatcgagccggtgtacagctgcaccgagaacgccgcgacgatggccgccagcgcggtggccagcgacttggggctgacgcgggcgcgggtgcgctcggcgttttctattttgcccagcgaatactggcgcggcttgcggtagctgaccagcaccgccgacagcaagccggccaccatgcccagcgccgggatcgccatcgcgtgcatcacgttgatgccgcggatgtccatgccggccttggcggcgttgcccagcaggatctgcttcagatagatgtcgccgaaacccaccgggaacaccatatagggcgtcaccaggccgaaggtgatcacgcaggccaccagccggcggtccagcttcagccgcgccatcacgtacagcagcggcggaatcagcatcgggatgaaggcgatgtgtatcggcaccagattctggctggcgacgctgacgcagcccaacagcaggatcagcgtccatttcagccggccgtggccgctgctgtgctccagccgcttcaccgccagttcggccatcgcgtgcggcaggccggatttggcgatggcgacggcgaaggcgccgagcagcgcgtaggacagcgccaccgaggcgccgccggtgatgccgttgttgaaggcggtcagcgtggcggacagcgacaggccgccggcgaggccgccgatcagggcgcccagcagcaggctgatgacgacgtgggtgcgcagcagcgccagagtgagcatggcgcccacggcaaggacaacggcattcatttgtatagacaaatcagtggcttatgcgcgacggcgcggggcggcgagggtagcgggttttgtccgggctgtcgagcgcggcggcattagacagtctttatatattaaaaagagataggattaaaatttcatattactagaagaaattacaagcgggatttacagtcaggacatcacctgaatccgtgcgacacggctaggaggcaagatggaggcgctactggtaggcgcggacagcctgggcaatatcccggaagtcctgcagcattacaatatccgcatcgcccgccacatctgcgggcgcaacgtcgcgcatcagcgcaaggcggcgctgccgggcaagccggacgtgctgatcctgctgaccgacttcctcggccacaacgtgatgcggcattaccgcgacagcgccgccgcgctggggattccggtgttggcctgccgccgctccgccaccgcggtggaacagcggctgcgccgccatggctggagccgcagcgcatgatcttttccggcaatgaaaactggctggcctggcagctgaagcaaaccgcccagcaggctttgccgcgggtggagtggctgaagataaaccgcccggcgcccgccaagccacccattcctcccgcgcgctgaaccgccgcctccggcacggctggccttgccgccgccgttctgccaaactgcccgccgttccccgccccgcttccgccgccgcgcggccgccgggcgggggctttccatttcatcagcaaggaagcgtcagatgtcggttttttccgttgaattcaaggtgcgcgactacgaatgcgacatgcagggcatcgtcaacaacggcgtgtatttcaattacctggaacatgcccgccatgagtttctgctggccaagggcatagacttcgcccagctggcgcgcgacaaggtcaatctggtggtggtgcgttcggaaatggattacaaggcttcgctgaccagcggcgaccaattcatcgtcaccgtggcgttcgaggctgtttccaaagtgcgtttcggttttcgccagcaagtgatccgccaggccgacggcaaggtggcgctggatggcttggtgatcggtaccgccatcaacgagcgcggccgcccggccatcccggaaggcttcgccgagcggctgaccgcctgaggcggactattccgccagcgtttccggccggatgccccattgctcgcgcaagaaggcgagcccggccggcgtgattctcagcgcgcggctatcctgccgccgctccacccagctgcgcgccagaaactcccggcatagcgccgcgccataggcgccggccaggtgcggccgccgctcgctccagtccaggcaggcgcgcgcctgcggccggcggccgctcgccggctcggccacgcccaacgcctcggcgaaccagccgcgccccgccgcggtgacttcgaactgcctctccccgttcagcgccagccagccgctcgcctgcatgccgtcggcgacggcgatgcccagtttgccggccaagtggtcgtagcaggtgcgcgccagcctgagcgtcggcgccacccggctggccgccggcttggccagatcgtggccatgcgccgccgcgctgagcgcctccaacgcctgggcgatggcggcattggccagcagatagtagcgatggcggccgtgccgctccactttcaccgcgccgccttgcagcagtttggccaggtggttgctggcggcctgggcgctgaggccggcgtgctgagccagttcgctggccggatagctcctgccgtccagcagcaacagcagcatgcgggcgcggccggggtcggccagcaggctggccagacggctgatgtccgggagatgggcggcgatcatggttcactccagcgtgaaacatcatggggaagggatggctacgataacggcattgaaagcgctagccaaggagtttcgccatgcaggccttgttggattatctgcaaagccattttctgagcgagccgcagttgttgtttcgctgccgcagcgcgcccgagcgcctgcgcgagctgcaacaggcggggcggatgcccttgccttcttatcgactgtccggatcgggcatggcgtcctcgcatttcggcgaacgccggatgcgcggcgagctggcctggtatccgcgagcgatgatggaatggctgatcgaggcggagcatgcggatgccgccgcgctgcgggggcgtttcgatcagcgttaccgcgccgagttgcgccgtttggcgtccgaaggcatcgcggcggagagcgaagcgccgttggatgaggagtgggcgcatttcctggctggggtgtacggggcatgcacccggcaggggcgaatcgaacagatcgcggccaagggcgcggccatcgccgtgatcgacaggctgaccgacggccagcggctggcgcgcgtgccggctgccgacattcctttattgtggcgggcggtggacctgctggacgcggtcagcgccttgttcgcgcctgatgagcaggcggctagctcccgcgcccgctgcgtggatgcggtgaagcgaaaatatctgggagaggcggcatgagcgcctggccgcaaaacgttttgatggccgcgcgccatcctgacccctatccctactaccgcagtctggcggagaagggctggcattacgacgaggccttggggatatggctggcggcgtcgcaccgcgccgtcggcgcggtcctggacagtccggtctgccgggtgcgcccgagcgggcagccggtgccgcccgccatcgacggctcggttctgggccaggcctttggcggctggctgcggatgagcgagggcgcggcgcatgccggtttgcgacgcgcggtgagggatagtctggcggccttgtccttaagcgaggtcgaaggggtggcggcagcgctcgcggcgcgcttcttgtccgagggcgagttgagcggccgccgcatagacggcctgatcgacttgctgcctgtcgccgcgctggccgcggcgctgggttggcctgcggcgcgcctgtccgctgtgggggagggcattgccttgctttgccgcgcgctggcggcggacgccgacgatgcggcgcgggagcagggcgctgcagcctgctgggccttgctcgacgaattggcgtctttgcctgtgaatggctggctgcggcgctggcgcgaggcttttgtggatttggacgaggccgcattggcggccaatctgctgggcgcgctattccagagccgcgacgccggcgccgggctgctgtcggcgggcatcgcttggcgttgcgagggaccgtgggattggcgtgatgcgggcgagtggaagcgccgcctgcgcgtcgatccggcgctgcatcacacccgccgcttcgtggcggaggatgtcgagctggccgggcagcggctcaaggccggcgaccaggtgctggtgttgctggcagccgccgcgcatgacccggcgggaccagcagaggcgctggatttcggccgcggccggcatgcctgtccgggcgaagggctggccttggcgatcgcctgcggcgcgctggacgcgttggaggcaagccgtccggattggcgggctttgggcggcggcatcgtttttcaggggccgccgaatatcagaatgcgccgcttcggcgcgggagagagcaaatgatcgcagtgattttcgaagccacgccgacggcggacggccgagatgcttatctgcagtgggcggcgcggctggcggagacattgcccggcgtagacggttttctctcgatagagcgttttcagagcctggcgcggccggatgctttgttgtccttgtcgttctggcgcgacgaggaggcggtggcggcctggcgcaatctggaatcgcaccgggcggcgcaggcggcggggcggggaaagtttttcgccgattaccggctgcgggtggcggcggtagtgcgcgactacggcatggacgaccgggcgcaggcacccggcgacagccgcgccgcgcactcaggctgacgccagcgccttgatcacgtacaggtcgaagcgggtggacttgccgtccagcaccgccgatggcttgacgccttcgatggccgcgcccaagcgcggccttttcaccaccacccgcaccttggcggcggcgatggcggcggccagcaattcggcgctgtccatatcgtcgcctatcacctgctggaaggcctgcatgtctttcttggcggcggcggctttcttgtcggtgtccgggaacatcgggtcgacgaacaccacgtccggccgttgatcgtcggcgaggccggccagccagtcgcgcgagttggcgtgcgccagcgtcatccgcgccgcgatgtcgcgggtgctgtcgtcgcgcgccgcgcgcgccagcgcgtcggccagcagcgccgccgccaccggcgagcgttccaccatcgtcacccggcagcccagcgtggccagcacgaagctgtcgcgccccaggccggcggtggcgtccaccacgtaaggcaaatcttttgcccctttcaggcccaccgccttggccaccggctggccgcggccgccgccctgctcgcggcgatggcgcgccgcgccctcgacgaattcggcatacaccgcgccgtgcttgccggtggtgaccagctccagccgttccgcgcccaactccagccaatagccgtcggcggggcgctggcggatcaggggaagctggaaacggtcggccagcaggcgggcggcatcgatgcgcgcggcttcggcgcagtagagcggggtggcggtcatcggcattccttgaaaactgttgcgcacgatacgggatgcgcctgtttgccgcaagccgggatgggagtggccaccgactggcgtttgctaagtaaatttatctaaagcttatttacccgaacaacatgttcttatgcgggcaactagtctatttatctagttgaacgtcctttattcatgctgcggcgatggccgtcggcagtggtcgggagagtcatcatggcatggtggaaatcggcaggccggcagcaggcggccaaacaggcggcccgtccggccaatcgcttgctgttgcaggcgctggagccccggatgatgtttgacggcgcagtggctgccaccgccaaccatgtcgcgcagcatgtcggcgtgatgcacgacccgcaggacgccggcgcgcagcagcatcacggcgaggctaggccggccgccgccgcggcgcagtcggccgcagaagcgccgcgcgcggtcggagcgcgcgacggcgcggccaacgtgccgcaagtggtgttcgtcgaaaacgacgtcgccaatctgcaaagcctggtgtcgcagttgccgtccaattaccaggtggtgattctggacagcagcaaggacggcctggcgcagatcgcgcagtgggcgcaaacccacagcggctacggcgccatccacatcatgtcgcacggccaggaaaacgatctgcagctgggcacgacgcagctgacgacggccaatgtcgccagctatcaggcggaattggccacgataggacaggccttgcgccccggcggcgacatcctgctttacggctgcgatgtggccgaaggcagcgacggcgcggcgctggtcaatgcgatcgcgcaggaaagcggccgcgtgacagccggctctaccgaccttaccggcgccgccagcctgggcggcgactggacgctggaatacgccaccggcaagctgcacgtggcgacgctggacctgtcgggctatgacggcctgctgacgcaaccgacttccggcaccaccagtttcgattcgctggacggttccaccaccgtggtgcccaccggcaacgccacgctgacggtaagcaattaccttggctggaatttcaccatgaacatgaactcgaacagcgacggtcagaacgagatgatcatcgtcgagaaggatggttcgagctccacggaaaccgtcgacgcgctgagcaacggcgtcaagcagatcaattatttctcggtcaagcccaacgatggcagcctgttcacgctgaactccatcaccgtagtgatcaatggctacgattccaccttcaacggcggcaccatgcagctggtgggctatctgaacggttccgccgtcgccggcgccaccttgagccagagcgtcagcgacatcgacaacgacggctcgccggtcaccttcaatgtgtccagcaacagcaatttcgtcggcatcgactccttccgcgtgatcgcggccaatggccacaacgtcaccggcctggtcggcatcggcgccatcaacgccaccaccttccatttcccggggccgacgctgaccgccagcggcggcagcagcgcctacagctccggcaacggcaacgcggtgacggtggacagcggcatcacgctcagcgataccgcggcctcgacccaaaccagcgccacggtatcgattaccggcaacttccacagcggcgaggacgtgctggcattcaccaataacggcagcaccatgggtaatatcagcggcagctacaacagcggcaccggggtgctgacgctgacctccagcggttccaccgccaccaatgcccagtggcaggcggcgctggaggcggtgacttaccgggacagctcgctgtcgccgaataccagcacccgcaccctcagcttcgccatcaccgacgccagcagcaacaccagttccacggtgaccaagaccgtcaccgtggcggcggacagcgcgccggtgatcagcaacctgaacggcgacagcaatacctactacgccggcagcggcgcggtgagcctggacaccggcaccgcggccacggtcagcgacagcgatacttcgaatttcaacggcggcaatctgacggtgcacatctccgccaacggccacagcggcgaggacgtgctaggcatcagcaccgccggcacggtcacgctcagcaacggcactaactccggcagtacggtgtcggtaggcggcgtagcggtcggcaccatagacagcagcggggtgggcagcggcgggcaggatctgatcgtcgacttcaacagcaacgccactgcctccagggtgggcacgctggtcaacgcgctgaccttcaacgacaccgccggcacgcccaatacctccacccgcactgtgcaggtgacggtcaacgacggccgcggcggcaccagctcggcgtctagcgtgacgctggcaatcagcgacgcgccgctgctgagcactagcggcggcagttcggccttcaccgccggcgacaacgccacctccacgccggtggcggtggacggcagcgtcagcgtcaccgacaacgccagcagcacgctggccagcggcaccgtgtccatcaccggcaacttccacagcggggaggacgtgctggcgttcaccaatgacggcagcaccatgggcaacatcagcgccagctacaacagcggcaccggtgtgctgacgctgacctccagcggcgccaccgccaccatcgcgcaatggcaggccgcattgcgggcggtgacgtataccgacagcgcggtgacgccgaacagcgccacccgcaccatcagcttccaggtgcaggacggcggtagcaataccagcacggcggtgaccaagacggtgacggtggcggataccgaccagacgcctatcgcctccgccagcggcggcagcacggccttcaccgccggcgacaacgccacctccacgccggtggcggtcgacagcggcatcacggtgtccgacctcgacaacaccacgctggccagcggcacggtatcgatcaccggcaacttccacagtggcgaggactcgctcagcttcaccaataccagcgccgtcacctacggcaacatcgtcggcagctacaacagcggcaccggggtgttgacgctgacttccagcggggcgacggcgacggtggcgcaatggcaggctgccatgcgcgcggtcaaatacaccgacagcgcggtgacgccgaacagcgcgacgcgcaccatcagctttgtcgtcaacgacggcaccaagaacagcgccgccaccaccaaaacggtgacggtggcggataccgaccagacgccgctgctcaccgccagcggcggcagcgccgcgttcaccgccggcaacaacgtcacctccactccggtggcggtggatagcggcgtcacggtgtccgacctggacaacaccacgctggctagcgcgacggtgtcgatcaccggcaacttccagagcgcggaagacacgctggcgttcagcaataccaactccaccacctacggcaatatcagcggcagttacaatagcggcaccggggtgctgacgctgacttccagcggcgcgaccgcgacgctggcgcagtggcaggcggccttgcgcgcggtgacttacaccgatagcgcgatcacgcccaacaacgccacgcgcaccatcagcttcgtggtcaacgacggcaccaagaacagcgccacggcgacacgcagcgtgacggtggccgacaccgaccagacgccgatcgccaccgtgtccggcgccaacggcagttataccctcagcggcacgccgacgccggtggcggtggacagcggcatcacggtgtccgaccgcgacaacaccacgctggcgagcggcacggtgtcgatcaccggcaacttccacagcggcgaggacgtgctggccttcaccaataccagcgcgtccacctacggcaacatcgtcgccagctacaacagcggcaccggggtgctgacgctgacctccagcggcgcgaccgcgacagtggcgcaatggcaggcagccttgcaggcggtaacgtacaacgacacctccggttcgcctaataccgccacccgggtgatcagcttcgtggtcaacgacggcgaagtgaacagtgccgccgtcacccgcaacatcgccatccagctgccgacgccgtcggtgagcggcctgactgcgggcaccgacaccggcagcagcagttccgacggcatcaccagcgacgccacgccgacggtgaccggcacggcggaagcggacagcaccgtcaccatctatgtggatggcgtatcggtgggcaccaccaccgccagcggcaccggcgcctggagctatgccttcagtgacccgatcgccagcggcagccatgcgataaccgccatggcaaccagcggctcggtgaacagcagcgtatcgactgcttacacggtgatgatcgacaccaccgcgccaagcgcgccgacggtgacaggtctgaccgctgccaccgataccggcagcagcagctccgacggcgtcaccagcgacaacacgccaacggtccaaggcacggccgaggcgaacagcacggtgacgttgtatgtggatggcacggcggttggtacgactaccgcggacaataccggtgcgtggttctacaacgtttccagcagcttggcggacggcaatcacagcatccgcgcgacggcgaccgataccgccggcaatgtcagcagccaggcgaccgcctacagcgtgaccatcgataccgcgacgccgacgacgccggcaatcagcggcctgaccacggcgacggacaccggcagcagccatagcgacggcatcaccagcgacaacaccccgacgctgcagggcaccgcgccggccaatagcacggtgacggtgtatatcgatggcttccaggtcgggacgactacggcgaacggcagcggcgcgtggagctacagcctgagcgccaatctgccggacggcaaccatggcgcgcgggtgacggcgaccgacgcggccggcaatgtcagcacgctgtcggcggcctacagcatcacaatcgacaccactgcgcctaatgcgccgaccggtctggcgctggccacgtcgtcggacaccggcagcagccacagcgacggcatcaccgacaacaaccagccgacggtgcaaggcacggccgaggcgggcagcacggtgacggtgtacgtggacggcacggcggtgggcacggcgacggcgaacggcagcggggcgtggagctacaacctggcgagcagcctggccgacggcaaccacagcatccgggcgacggcgaccgacgcggcaggcaacatcagcgcgcagtccagcggctacaccatcaccatcgacactaccgcgcccaatgcgccgactggtctggggctgagcgtggcgtcggatactggcagcagccacagcgacggcatcaccgacaacaaccagccgacggtgcaaggcacggccgaggcgaacagcacggtgacggtgtacgtggacggcacggcggcggggacggcgacggcgaacggcagcggcgcgtggagctacaacctggcgagcagcctggccgacggcaaccacagtatccgggcgacggcgaccgacgcggccggcaacatcagcgcgcaatccagcggttacaacgtcaccatcgacaccactgcgcccaatgcgccgaccggtctggcgctggccacgtcgtcggacaccggcagcagccacagcgacggcatcaccgacaacaaccagccgacggtgcaaggcacggcagaggcgaacagcacggtgacggtgtacgtggacggcacggcggtggggacggcgacggcgaacggcagcggcgcgtggagctacaacctggcgagcagcctggccgacggcaaccacagtatccgggcgacggcgaccgacgcggccggcaacatcagcgcgcaatccagcggttacaacgtcaccatcgacaccactgcgcccaatgcgccgaccggtctggcgctggccacgtcgtcggacaccggcagcagccacagcgacggcatcaccgacaacaaccagccgacggtgcaaggcacggcagaggcgaacagcacggtgacggtgtacgtggacggcacggcggtggggacggcgacggcgaacggcagcggcgcgtggagctacaacctggcgagcagcctggccgacggcaaccacagcattcgggcgacggcgaccgacgcggccggcaacatcagcgggcagtcgaccggctacaccatcacggtggacaccgccgcgccccaggtgcagagctttaccgccaccgacgccttgagcacttcggccagcacgctgggctaccaagtggtgttttccaaaccggtggtcgggttcaacgcagccgacctgagcgtggtgaccagcagcggcgcgcatggcacggtggcgagcgtcacgcagatcaacgcgaccacttacgccattcaactgaccggggtgggcggcgacggcaccctgtcgctggcgatcaagagcggcacggtcagcgatgtcgccggcaaccagctggcgggcacggtcagtgtgcccgcgtatcaggtatcgacgtcggtggtgatgaccagcacggtgacgccggtggcgactgtcgagacgaccagcttcggcaataccatacagctgccgccgatcacgcccaatatcgtgttggccgcggtcagcggcaaccctgcggtgacgaccgccaacggcaacaccgctccagggacgggcacgctgccgaccgatcatgccggcgtcggaaccagcgtcactacgcctactttcggtacgacggacaccgtcaatggcgcggcgccgtcctttgtcagcaatgtggcggccaaccccaccatcgcgctgcaggtgaacccggatcttggcgtcaggccgctggtgtccgggcagtctttctccatcacgctgccgccggccaccatcatcacccgcgagtccacggccagcctgagcattgtcgcccggcagagcgatggccagccgctgccctcgtggctgaagttcgacccggcgacgggcaaattcatcgggcaggcgccggcgggctggaacaagccgatttcaatcgacatccgcgtgcaggacaagagcggccaccatggcaacagccacatccagctcaacttcggccagtcgcgtgcgaacggaacgccggcgggcaaggcggcaggcaaggcggccgccggcaagctggcgttgaaccagcagttcgaccgccacggccacaaggctttcctgcagcggatgcaggcatggctggagggcgatgggcaagcgtagccttgcgcggcggcaggcatggcggggttcggaccccggcattttccaagttcaaggggacagcagcatgcaatccaaagatcaagcgggatcatgggtggttcgactgaccgttctggccgtcgctgcggcgctggccggctgcgcggcgacgccgcagccgatcagcctgtcggagcggcaggccacgctcgccgccgacaggcaggcgatgttcggcagccaggaagcgttgtccgcgccggtcaccttgcaggaggcgatggcgcgggcgctcaaatacaatctggattaccgggtgaagctgatggaagaggcgatggcgcagcgccagctggatctgtccagcctggacatgctgcccaagctggcgctggcggcgggctacacctcgcgcagcaaggacaacgcctcgtcctcgcaaaacatcgccaccggcgagcagtcgctggcgccgtccatctccagcgagaagcgcgaccgcaccgccgacctgaacctgagctggaacgtgctggacttcggcgtcagctatttttcggcgcagcagcaggcggaccgggtgctgatcctggagcagcgcaagcgcaaggtcgcgcagcagctgatgcagcaggtgcgcgaagcgtggtggcaggccgccggcgcgcagcgcctgcaagggcgggtggacgcgttgctgaaagacgccgaatcggcgctggacgacgctcgccacgtcgagcagcagaaactgcgggcgccgctggacgcgctcaattaccgccgccagctgctcgacgtgatccgccagatgagcgcggtgcgcaacgcgctgtcgcaggccaagcccaggttggccgccatcatgaatgtgacgccgggccaggacttccaggtggccgcctccgccgacatgccggtgccggcgctgggcatcgatgtcgacaagatggaggacatggccctgctgaaccggccggaagtggtcgaagccaattacagcaagcgcatcagcgcgctggagacgcgcaaagccatcgccaagctgttgccggggctggagttcagcgtcggccagcattacgacagcaacaaattcctgatcaacaactcctggagcgacgccgggctgcgcatcagctggaacctgctgaacttgttcagcgcggggccgatcacgcgcgcggccgaagcgcaaaagcgggtggacgacgcgcagcggatggccttgaacatggcggtgctgacccaggtccatgtcgcttatctcgacttccagggcaaggcgcggcagttcgaactggagcatgagctcaacagcgtcgaccaggccatctatgagcaaacccgcaatgcggtggacagcggcgccaccgcgcggctgcagggcattctggccgacgccaacgcggtgttttcgtcgctgcggctgttccagacctacggcgatctgcaaaacgcctatggccaaatgggcgccagcctggggctggacccgctgccggccgctacccagggctatgatctggcttcgctcagcgccgcgttccgcggctccgaaaccaaatggcagggcacggtggcgggaggcgcggccaaatgataacgcgctggctcaccctcgccgccatcggactggccggccacgccggcgcggccacgccgccggcctcgacgctcaacgccgccgacggccgcatccgcgtgcagctgatgtcgcgccacgcggtgaccctgtccagcgaaatcccagccaagatctccgcgctgccggtagtggaaggcggaagcttccgccgcggccagccgctggtggagttcgactgcagcagctaccgcgcgcagctgcgcaaggcgcaggcctcgctggaggctgccagccagctgttgaaggtcaacaatcagctggccaaatacaactcggtcggcacgctggagctgacccaggcgcagggcaaggccaaggaggccgccgccgatgccagctacgcgcagacgctggtgtcgaagtgcagcatcgcggcgccgttcgacggccgggtggccaagcgcagcgcggcggtgcaccagtatgtcagcccgggcaaccccatcctggacatcgtcgattccgactcgctggagttgcggatgctggtgccgtccaagtggctggccacgctgaagccaggcagccgtttcacgatctcggtcgacgagctgggcgccagcttcccggcccggatagagcggctgggcgcgcagatcgacccggtgagccagtccatcctggcgataggcgtgatagacggcaaggccggcaacttgctgcccggcatgagcggctgggccagtttcaaataaggccatgggacacgccgacaaaagtctggaactggccaccctgctgcagctgcagcgccatgcgcgggaggccgacagcgcggcgcagctgggcttcgtgatggtcaacgaaagcctgcagctgctgccctaccggcaggccgcactttggcgcgagggcctgcatcgccatgtcgcaaccttgtccggcctggttgatcccgaccccaccgcgccctatctgcaatggctgagcgccttgttccgccaattggcgcgcgaggccgccggcgcggccagccggcgctgcgaagccgccgacctggcgccggcgctggccgcggaatggcagcaatggctgccgcagcatgcgttgtggctgccgctgggcgagcatggcgccttgctgttggcgcgcgatcaaccctggagcgactacgagctcaagctggcggaagagctggcgcacgcctacgcccacgcgctgcggcagttcgcgccgcgccgcaactggcgggcgctgctgcgggatggcctgcgcgccggaccgcggcggcggcgcgcgttgttggcggccctactggtggcctgttttcccattcgccagagcgtgctggcgcgcgccgaagtggtgcccagcgacccgatgctgctgcgggcgccggtggcgggggtgatagaccgcgtcgaagtgtcgcccaatcagccggtgaagcgcggcgcgcccttgttcgatctggacgccaccctgttgtccggccagtttgagctggccaaggaagaaaggcgggcggctgaggaaagcttccgcgccagcgcgcagttggcggtcaccgatgacaagggcaagctggcgatggcgcaggacaaggccaggctggaggagaaggacatcagcgccgatttcgccggccgcgagctcaagcgtctgcatgtcaccgctccggccgacggcgtggtggtgttttccgaccgcaacgactggcagggcaaggcagtagcccagggcgaaaaggtgatgacgctggcggaccccgccaaagtggagctgacagcctggctgccggcggccgaggccatcgccatccagcccggcagccaggtcacgctgtatcccaacgcctcgccgttccgctcctacgatgccactttgctgcgggtggcctacaaggccgaagtcagtgagggcaatctgctggcctaccgtctgcaggcgagcttcgccgccggccagcgtctgccgcaattgggccagatgggcaccgcgcgggtgtatggcgactgggtgcctttgtcctattacgcgctgcggcggccgttgacggcggcgcggcaatggctgggctggtgatgggcgccgcggcgctgccgccgctgcggcaggagttgaccctgcacgccggcccggcgcaggcggacggctcgcccagctggatgctgcacgatccgggagccaaccgtttctatcagctgggttgggccggtttcgagatgctgtcgcgctggccgcttggcgacgccgcggcggtattggcggcggtgaatgccgaaaccacgctcgaactgggcgaagacgatctgctgcagctgctgctgtttttacggcagcaccaattgctgcaaccgcttgcccccgccgattgcgagcgggtctggcgccagtaccaggccggcaagcccgggcatgcgatgtggctgttgaagaactacctgttcttccgcattccgctggtgcggccggagccggtgttgaaccggctgctgccctggctggcggcggtgtttcggccggcgttctggtggctgatggcgacggtcgccgcgctggcgctggcgctggcgtcccggcgctgggatgagttcactcataccttctccggttacggcggctggagcgccgcattgggcatcgcggcgtcgcttagcttggccaagatattgcacgagctgggccatgcgttgacggcccggcatttcggctgccgggtgccggcgatgggagtggccttcctggtgatggtgccggtgctgtacaccgataccagcgacgcctggaaactgccgtcgcggcggcagcgcatgctgatcggcgtctccggcatgctggcggagctgacgctggcggcctgggccacgctggcctggtgcttcctgccggacggtccgctgcgggcgggggtgtttctgctggccaccaccacctggctggcgacgctggcgatcaactccagccccttcatgcgcttcgatggctatttcctgctggcagactggtggggcatgcccaatctgcacgcccgcgccttcgcgctggcgcgctggcagatgcggcagtggctgttggggctggacgacccggttcctgagttcttccagcccgcccggcgccgcgcgctgatcctgttcgcctgggccacctggctgtaccggctggtgctgttcctctccatcgccttcctggtttaccacctctttttcaagactttgggcctgctgttgctgggcgttgaactgggctggttcatcgcgcggcccatcgttgccgagctgcgttgctggtgggcgcggcgggcggatttgcgctggcagctggaaaccgcgcgcagcgccgctttgttggcgttgatcgctctgtttctgttgctgccgtggcagcgcgatgtcttctccagcccggcggtgttggccgccgcgcaatcgcaaggcttgtacgcgccggatgcggcggaggtggtcgaggtcaaggcgcgggatggccagcaggtgcgggcgggccaggtgttggccaggctgtactcgccggaattggcccggcaaatggcgcaggcccaggtggtggagcgccacctggcctggcaggcgtcgcagcagccgttcaacagcgagttgcagcagcaggggccggccttgcagaaacaatggcgggccgcgcagcagcaggtggccagcctgtcccggcaagtggccagactggtgctgacggcgccgttcgccggccgggtggcggacagcagcgaggcgttgcggccgggcaccgtggtggccgagggcgagcatctgctggatctggtcgggccggacggggcgcggggggaagcgtttgtcgacgaggacagcctgatcgggctgcggcgcggcggccgcgccagctttgtgccagacagcggcgagggctgggcggtgtcttgccggctgggaccgatagacagcctgaatctggccacgctggaccagccgctgctggcttccactttcggcgggccgatcgccaccgaagcgcgcgaccatggcctggtgccgttgagcgcggtgttccgggtccggctggaggactgcgaccgccaggtcgcgccgctgcgcgaaaccgcgggttgggcgaagttgcgcggcgagcgctacagcctgttgcagctgggttggcggcatcttctggccgttgtcgagcgcgaggccggcttgtagccgttacgcgctgtccgatcgagacggcgctggttttcccatcattcaccgtgtcaattccaaggagagagcatggccgccgaactcaatttcgcctccctggcccagggcctgaccctgaggccggcgcagtccgccgacgcgcctttcatcgacaaggtctaccgcagcgcgcggccggacctgcagtggatacagggggagcgcgaactgatcgatacggtgcagcgccagcagttgcaggcgctgctgcagggcgcggggcagaatcatccgaacgcgatgcatttcgtggtggagcagaccggcgccgccatcggcgtggtgatggtggacttcggccataacgaggtgcgggtcatcttcctggccatgctgccggagacgcgcgggcggggctatggcaagcaagtgctgcagggcttgcagcaggcggcgcgccaggtgcgttgtccgctggcggtggtggtgtggcatggcaacgagcaggcgcggcgtctgtatcagtcgctgggtttcgtgctggaagaggcgggcgcggtggccgacaagctggtgtggtatccggacggccggtccatcatggtcggggcggtttgaagctgccagccgctggcggctggcgctggcggcgttaattgaacggcaactggaaatagcagtactggcggtcgcggcccatggcgccggtgcggctgatccagacgttttccagccgccgttcgggcaggccgtctgccgccggcaggctcagggtgccgacggcgtccaccagttcggtggcgtgggcggcgaccaactccaccacgaaaggcgtgcgctgcgtgtcctcccggccaggcacctgcgccagtggcttctggcggacagtctggatccgcaattccagttcgggctgctgctccacgctgaacagacagctctgccccagcaagggagcgaaatcttcgctacggagttcggccagcatcgggttctcctcggcggcgcgggcgggccgcgccgcctgcagtggcgttattgtctggtggggaagatgccttgcacggcgatgcagaaattcagcgccaggtaggggttgagcacgctgaccggggcggtgccgccggcggtgtcggtattgccgctcagtcccagccctttgacggtgaccgggctctccagttgttggctccagatggtggcgaggccggtgccgccgccggaggcgcccagataggggttgctggtgctgggcgcgctggccggtgtcgtcgggttcgggacggtggaggcctggaagctgacgttgacggccgaggtgccgtggttgtgcagcggcatgttggcggtcagcaggttgacggtctgttggccgccgaagttgccgatggcgtaggacggcaggttgtaggtgggttgcgccggcccgatgctgatgggcatccggccacacaaattgggcaactggaatacggtgctgccattgccgccgtagtggctgccgatggtggcgaaaagcgcctggttctgggagacctgcagggtttggccctggcattgcgcccagtctatcgggggaaagtcgaagccaaaggcgagaatggtgccgatgtatgcgtccacgtttgctccttcgtcagtgatcccgccagcgggatgccggcagggctgtaacttccgcgattgccacagattcagcttatacagaattcaatttaatcaacattgtcatttgccatgatggtatttccacttaatcggcggccgggcggaggcgaaatgccggatggccgcgaacggcgcgccaggcccgcgcctggcatggcggcgctgattgcctgggtcgtcggggtggggggctgcgctttcctgccggctttgccggacctgcgcgagtatgcgctgctgccggcggcgctggccgcttgtgcctggcggtcgggctggccgctccgccgatggctgctggtattgctggcgctgtgcctgggtcttggctatgccgcagcgcgcgcgcagtggcggctgcagcaggaattgccggccgcctggcagcagaagccgattgcgttcgtcgcggtggtgcgcggcctgccagatcccggcgagtacggcgtccggctggtgctggaggtggagcggacgctgacgccgggcgcggcgctgccggagcgggtgcagctgcacgactatctgaagcgggactggccgcctggcagccgctggcaattgagcgcgcgattcaagcccaggcgcggcagcgccaacgcgttcggcttcgacgccgaacagtggctgtggtcggaggggctgctggccagcggctcggccggcaaggagcggcggaggctggccgacgggcacggcctgatggcctgggtggacggctggcgcgcgcgccaagtggcgcgcatcgaacgggcgctaggcaccggcagggagtcggcgttggtggccgcgctgacggtgggcgcgcagcagcgggtggcgcgggaggattggcaattgttcgccgccaccggcctgacccacatcgtgtccatctctggtttgcacatcacgatgctggcgggattggcgggctgggcatgcgccagcctgctgcgccgctggccggtggcgcgcgcgccgcgtttgctggccgccggcgccgccctgtcggcggccaccgtctatgcgctgctggccggcttcacggtgccgacccagcgcaccttgttcatgttggtggccggctggggctgtttgcagctgcgccgccagctgtcgccgttccaggtgtggtggctggcgctgtcgttgaccttgctgctggacccgttcgcggtgttggcgcctggcctgtggctgtcgttcggcttggtggcggcgctgatgttttgttcgttggcgcggcgtcggccgccgccgggctggcgcgccgcgctggatggccaatgggcggcgggggtggccagcttggtgccgctggcggcgctgttcggcggttttccgttgttgtcgccactagcgaacgcgctggccatccccttcgtttccatgctgctgacgcctgcggcgctgctggcggtggctttgccgtgggatggcttgttgccgctggccgcttggctggcgcgagctttctacttcggcgtggagcggctggccgccgggccggcctggcatgtggcgggcgcgccgtggccgctgctggcgctggccggcgcgggttcgctgtggttgatcgcgccgcgcggcgtgccgggcaagcccttggcctgcctgctgttgctgccgggtttgctctaccggccgccggggccggcgcgcggcgaatttcgcgcgacggtgctggacgtggggcagggcttgtcgttgctggtgcagacggcggagcatgcgctgctgttcgacaccggcgccggcgacgccggccgggtggtgctgccgcagttgcgcgggctgggggtggcgcggctggacgcgctgatgctgtcgcatcacgacaatgaccacgacggcgcggcggccggcgtgttggcggccttgccggtgggaaaggtgttggccggccagccgcagacgctgccgcgggccgcagcttgccggcagggccagggttgggactgggacggcatacgcttcgatgtgctggcgcctggggccggggcggcggcgggcgaggacaatgctcgcagctgcatcctgcgggtggcgggcggccgacatgccttgctgatcagcggcgacgcgccgcggcaggtggaggacgcgctggcggcgcagcccggcatccggctggccagcagcgtgctgatcgccggccaccacggcagccgcacctccagcggggaggcctggctggcggcggcgcggccgcggctggcggtggtcagcgcgggctttctcaaccgctaccgccatccgcatccgcaagtgttgcagcgcttcgagcaatacggcgcaacggtgctgcgcaccgatctggacggcgcggtgacgctggacttcggccgcgagctgcgctggggctgcctgcggcagcagcagccgcgctactggcgcgctcgcggcgcctgcggcgggatcagccctgactgacgcgggcgatcacccggttgcccttgccttcgtagtgcaggctgtcgaaggacagcttgcgggcgatcaggatgccgcggccgtggctggtcatcagcgaggccggctcggcgttctggtagtactcccagtcgaagcccgagcccatgtcctcgacgatgaactgcagctgctgcccgatcaggctgaattccagcgacacctcgcggtcgcggtattccggcgccagctgccggcgctccagctcctgctcccattcgccgctggccagcagctggcttttctgctcgtagctgatgtccagattgccgtgttcgatggcattgaccagcagttcgaacagcccggtggccacccgctccggctgcgagctggtcttggccagcagcgcggtgatggattgggcttcgcggtgggtgcggcagcggaagcgggcgccctgcaggtggcgcagcgcgtcgacatgcagattggccaattcgcggaaatgggcgtagcggtcccagtggccgacggcggcgccgacgatggccagcagcatgtcgcgagaaaatggcttggtcaggtagtagaaagcgccggcagccaagccttcctgcacgctggaggcggcgcccatcgcggtttgcatgatgacgggcaggaactccagccgcggctcggccttgatcttcttgagcacgtcgaagccgctcatgcccggcatcatcttgtccagcaggatggtggagaactgttcgccttcgcgctcgaggatctgccaggcgacttcgccgttttccgcttgccgggtttcgtagccggcatcctccagcagttcggtcatcagttccagattgaacggctcgtcgtcaacgagcaagagtttgtgaggcatccggcgttccctcctctaggttacgctgaaaatgactgggaatggaaaaggtgaaaatggcgccgctgtcaggcagattgtcggcaatgatccgaccatgatgggcgtggatgatttcgcggctgatggccaggcccaggccggtgccgccggcgccggttttggtggtgctgctctggatgaacttgtcgaaaatggtttccagctctttttccgggatgccgggcccggagtcggccacgctgacgtgcgcccattcctggccgtcctgttcgtccaacagcgcccgcacgcggatttccgagccggcggggctgaacttgacggcgttggacagcagattgcgtatcacctggccgatgcggaaggggtcgatgtcggccgctagggtttccggcgcgcattccagatcgatgcggatctggttgcgggacgccatcggcgtcatttcgtcgcaggcttcgcgcaggcattggctgagattgccgcggccgatgttgtagtccatgcggccgacctccatcttggccatgtccagcaggtcgttgagcagggtcaacagccggctgccgctggtgttgatgcgggtgaagtattgctccagtttggcctcgcccagactctgcgcgcgcagctgtcccatttcggtgaaacccaggatggcgtgcagcggagtgcgcagctcgtgcgacatattggccaggaactcggtcttggcgcggctggtttcctcggccaggatcttggcgtggcgcagggtttcctccagcgagcgctgcgcggagatgtccaggtacacccagatggtgccgagcttgggcaccgaggggttgaccgcgcggccgtgcaggcggcaccagaacagctggcctttgccggtgcgcagccggacttcggtttgcaccaccttgccatcgttgagcaggctgtacagggccttgccggtgcgctcccattgttcggggttttcaaagtaaggcatggtggggcggccgatcacgtcctggccctgctgctggaacagctccagaaaagcgtggttcacctggcgcagattgcggtcgacgatataggccatcgccagcgggctggcgtccagcagcgccgcaagctgccggctttgcacttccacttgttcggcgaggctgttcttcagctggatcagcgcttcttcctgctccttgcggcgcgagatatcgcggcagacggtgacgtagaaccagtcatccggcatcaccacccggctgagggacagctccactggcagctgttgctcgtcgctgcgcagcaagcgggtttcgaacggccggccttcgtgctggctcgcggtctgctcgaacgcgtggccggggtcgggattgtacagatcggggaacaacacgccggcgggcaggttttccagcgagtgggcgctttgctccaccagtttggccgccgcggggttggtctgcaggatatggccgctgcggtctatcaggatgatggcgtcggagctggcctccaggatggcgcgctggcgggcctcactttgcgccagcgcctgttccgacatcacccggtcgctgatctgctcgcgcagcgtgcggttgttctgctccagcagcagttgctgttgtttgagctgttcgtgcaactggcgattggccagcagctggcgttgctgcagcaacagcagcagcgccagggtggcggacgaggcgatcagcaccgtccaggccatcgggctgagcaggggctgcaccggctgcagcgaataggcgcccagcagcaattcgttgccgccgaccttgctgcggcgcgagaacatcggcggctcggtggggatggggcggcccggcgccgagtccagcagcggcacgtcgggctggttcttgctccagatcagcaggcggacatgatgcagcggattgtcggtgatcagctcgttgcctatcggctgcatcagcttgtcttggcgcagattgagcagcagcagcgtgtggtcgtcgcccagccgggtgatgatgtcgagccggatgccgcctaggccggagagctggctgggcagcagcatcggctggtcgctgcggcgggccaggtccagcagccatttggagtcgcccagatggctgaggtccaatccctgcggcagcgcgttggcgtcgtctggcaggtagctggccaccgggtagtactgcaattggaccgggctgggctgcaggtgctggttcttcaggaagcggatgctggtggcgatgcggttttcgaaggcgtcgcgctggttttgctcgaccagcgccacggtgccgatgccggcgaacacgctgtcctcgcgcaccacgcggcgggccatttccgccaggccgcgcgcctggccgttgctggccagctgctgcgccatgatccgggtatgctccagcgcgtcctccagctgcaccaccaccagaccggtgccaagcgccccccagtgctgctgttcctgcagacgttcggcgcggtcatgctccagcagcagccagtattcggtgaacagcaggcccgcccccagcaggcagcccagcaatagcgaggtgagtcggttcaacctcggcatctgtttcctcgtcagcgctcgctcaattcttgatacagagcctcgaattcacgggacagcttgtggcgcggatccaggtacaccatagggcgggcggcctggtgcgattcgcggatcttgaccgacgccgacaagggcgaggccagcaccggcaggccttcggccttcagctcgtccaccagccgcaccggcaggctggcgcggggctggaactggttgaccacgatgccttctatatacagcgcgggattgtggtcggagcggatctcgtcggcgctttccttcaggttatagagggcatgccgtgagaatgcatcgcaatcgaagggaatcaggcagcggtcggcggcgatcagcgccgagcgggtgtagaaattcagcgccggcggcgtgtctatccagatttcgtcgtaatgcggcgccagctggtccagcgcttccttcagcttgaacatcttgtagcgcgactccagcttggccatcagttcggccagttcgggctgggaagccagcagcgacaggccatctatgccggtggcgcggacgaagtcctgcggctccttgccgaacaacgagatgttgagcatttgctggaacaggtcggcgacgctggggccggcctccttcatcgcctcgcccagcaggtagtggctggcgttgccttgcgggtccaggtcgatcagcagcacccggcggccgcggctggccgccactgccgccaggttgacggcgatggtggatttgcccaccccgcctttctgattgaataccacgcgtcggatagtcatggggattcctgttgattggcgggcggcgggcgggatcagaagccgggatcagaagccgggctgtcccttgcagaccagcagcatctgctggtaactggcggaattctgcacgaccggcatggcttttatctgactgtcattataggagaagctggcgatctgccggccgttttcatcgaacagcgtcatgtccagcaggcggaaggtgtgctgggagcagtctatctgccaggtattcagcgaaaccttgtgccgcggcgtggacaggaagttttcctgcttcaggttgaagatggtcttgcggtcgcggaaggtgaccagcgggccctggcgcttgagcgacagccagtccagctcgttgaggatgttgccgttgggcgagacgcccagattctgccagtcggcgctggccggcggcggcgccggctctgccgctttggccggggcgggggcggcggcctgctggggcgcggtggcgcagccggccagcaacagcagggcgaacaagggggcaagacgagtacgcatgttgatctccagaatatcccgccagtgtcgcatagccgcccgccaggggaaaccggctggcgcggcgcggcatgaatttgcgaaaagcgcggaactttatcgcggcggggcgggtctgtcacagtgcgagagcatttttcctcttcgtttcacattgtctccatccaacttgtggccgccatatcctggcggcttctttttttgtcccggcgcattcctccccccgcttgccgtacaatggcgttttttcccgcagatcgcacccggcatgcacgacgcagtctccatcctcaatcatgttttcggctacccggaattccgcgggcagcagcaggagatcgtcgagcaagtcgcgcatggcggccacgcgctggtgctgatgcccaccggcggcggcaagagcctgtgctaccagattccggcgctgctgcgcgacggcgtggccatcgtggtgtcgccgctgatcgcgctgatgcaggaccaggtggccaccttgcaggagctgggcgtggccgcggcctgcctgaactccgccacctcgccggaagaggcgcgcgacatcgcccgccaggcccgcgccggcacgctggacctgttgtacgtggcgccggagcgcttgctgacgccgcgcttcctggaattcatgtccagtctgaacatcgcgctgttcgccatcgacgaggcgcactgcgtcagccactggggccatgatttccgtcccgaataccagcagctgggcttgctggccgagcgcttcccgcaagtgccgcgcattgcgctgaccgccaccgccgacgagcagacccggctcgacatcatccattatctgaagctggccgaagcgcgggtattcctgtctagcttcgaccgtcccaacctgttttaccaggtggtggaaaagcacaacgccaaaaagcagctgctggacttcatccgccaggagcaccagggggccaccggcatcgtctactgcctgtcgcgcaagcgggtggaggacaccgcgcagtggctgtgcgacaacggcatcgaagcgctgccctaccatgccggcctcagccacgcccagcgcgaggcgcaccagcgcagcttcctgcgcgaggatggcatcgtgatggtggccaccgtcgccttcggcatgggcatcgataaacccgacgtgcgtttcgtcgctcacatcgacatgcccaagagcccggaaaacttctaccaggagtccggccgcgccggccgcgacggcctgccgtcggccagttggttgtgctacggcctcaacgacgtggtgcagctgcggcagatgatagaaggcggcgagatggccgagctgcagaaacaggtggagctgtccaagctggatgcgatgctggccttctgcgaaaccgccggctgccgccgccagcacatcctcgcccacttcggcgaggacagccgcccctgcggccattgcgacaattgcctgcacccgcccatcacttatgacgccaccgaaccggtgcgcaagctgttgtcctgcatttatagagtggggcaacgctttcccaccggccatgtcatcgacgtgctgctggggcggcaaagccccagcatcggccatcatcgccacgaccagctcagcacttacggtatcggcaaggatatgaaccagcgctggtggcgctccatcgtccgccagctggtggcgcgccaactggtgcaggtggacatcgcccgcggccagtcgctggtgctcaccgatgcctgccggccgctgctgaagggcgaggaaagcatctatctgcgcccgctggccgacgagaagaagtcgcgcggcagcgccgccgccgaccgctggttgcgcaccgagcgagaggagaggctgtggcaggcgctgcgccgctggcgccgtcaggtggccgacgagcacaatgtgccggcctacgcggtgttctccgaccgcacgctgcgcgatctggtggaaaagcgcccggacagcccggccggcctgcgccatatccacggcctgggcgagctcaagctggcccgctatggcgaagccttgctgcaatgcctgagcgaggcgcagcaagcctgacgcgaggctggttttgctgcgacgcaaatgaccagattcttatataatcggtcgcatatttgtaaattgtggagtatcgcatggctgtgaatctgaatccgccgcaagccggcctgctgccgccggtcgccggcgtcgaattgctggtggccgaagccggcatcaaaacgccgggccgcaaggatgtgctggtggtacgtctggacaagggcaataccgtggccggcgtgttcacccgcaaccgtttctgcgcggcgccggtgcagctgtgccaggagcacctggccgccggcgtgcagatccgcgcgctggtggtgaataccggcaacgccaacgccggcaccggcgtcgatggccgccagcgcgcgctgagcgtgtgccaggcgctcgccgcgcaaagcggcgtgcagaccgagcaggtgctgccgttttccactggcgtgatcctggagccgctgccggccggcaagatcatcgccgctttgccgacgctgcgcgccgccgactgggccgatgcggcccaggccatcatgaccaccgacaccatagccaaggccgccagccgcacgctgcagctggatggcaagccggtcaccatcaccggcatcgccaagggctcgggcatgattcatcccaatatggccaccatgctgggattcgtcgccaccgacgccgccgtcacccgtccgctgctgaaccaattgctgcgcgaagtggccgatctctcctttaatagcatcacggtggatggcgatacctccaccaacgacagcttcatcctgatttccaccggcaagagcgaggcgggcctgatcgactccgccgagcagccggcgtatcagcaactgaagcaggcgttgctggaagtggcgatcgaactggcgcaggccattgtccgcgacggcgagggcgccaccaagttcatcacggtggacgtcaacggcggccgttctgtggccgagtgcaaggatgtggcctatgcgattgcccgttcgccgctggtgaagaccgccttcttcgcctccgacccgaatctgggccggctgctggcggccatcggctatgccggcgtcgccgatctggatgtggatcgcctctccttatatctggatgatgtgctggtggcctgcgacggcggccgcaatccggcatacagcgaagagcagggtcaggcggtgatgaaccagagcgaaatcaccgtgcgagtggagttggggcgcggcgccgccagcgccagggtgtggacctgcgacttctcctatgaatatgtgcgcatcaacgccgactaccgcagctgattcatcctgagataaattgaaaaatggcgtgtaacagtaaaaagcctccagaaacggaggctttttgcatttttctcagcagcgcacgcagccgctgtggcactttctgttggcttctcagcctgaacatcaagagcagggtttttattaaatgtttaaaatcaacgacttgtcgataattctgtaaaattcttcaacttttctcaaaaaagcggttgaccgagggggagggcgcaggtatagttcgtctcctcagctgacgcagcgtgtttcgttcgctgcgtcagctgaggagacgaactatacctgcgccctccccctcggtcaaccgcttttttgagaaaagttgaagaattttacagaattatcgacaagtnaggccatcttgaacacaaaaccaaagcgatgcgccccatcccccatcagcgcaagccgtctccgaagccattcccaaggttttaagccgccggttgttcgacgcggggcgacgttagcgccccgctagttccggcggctccttgggaatggttttggagacggggtttcgccgcgctgttggggtcgcctaggggtgtcggggagctggcgagacagctccctgacctgtccggcgggcagccccgccatgaaaatcatcgtccgcgaagcggacaccaaaccacacaccgtgcgcggtaaacgttgggcttcgctgcgctcagcaccaacctacactccaacgaatcctaggccatctgaaacatagaaccgcaccagctcgccgacatcccccatcagcgcaagccggcttcgaaaccattcccaaggttttaagccgccggctgttcgacgcggggcgacgttagcgccccgctagttccggcggctccttgggaatgggtttggagacggggtttcgccgcgctgttggggcggcctgggattgccaaggggctggccgcacagcccctggcccgttcgccgggcggaaccggcactaaaatcatccgtccgcgaagcggacaccaaaccacactgtgcgcggtaaacgttgggcttcgctgcgctcagcaccaacctacacgccagcgaaatcccaggccatcttgagcacaaaaccgaaccgactcgccaccattccccatcaacccggtaagttgggctccatcgtaggttggcgctgagcgcagcgaagcccaacgttcaccgcgccctactcctgcaactgcaccacaacaccttcccctgcccaatccgcaggcaaccaccccaacctgacatagcgatggaagctggaatacggccaatccgccacccgctccgcatcgccatgcttgaccgggttgtaatggatgtaatccacatgcgcctgcaaatccgcctcatcccgaatctgatgctcccaataccgccgctgccagatgccgcgctcccgcttgcgctctcgactctcccggatgcgttcgactttgggcagactgcgcgaaaacgccgccttgatcagcgccattcttgtcgcgtaatccgcgtcgccctgcggcaaggcccataccgcatggaaatgatccggcaacaccaccatggcgacgatctcaaatggatggcggttccgcacttggcgaacaacctgccgcaaaacgtcgatatggcgagtcagataatcttgtcgccgatccgccaagttgacggtgaagaaccatgtgccgccttctgccattgaacgacgataacgcatggattgcctccagcacacccgcggtaaacgttgggcttcgctgcgctcagcgccaacctacacgccaacgaatcccaggtcatctgaaacatagaaccgcaccaactcgccgacatccccatcagcgcaagccggctccgaagccattcccatggttttaagccgccggctgttcgacgcggggcgacggtagcgccctcgcgaagcggacacaaaaccttcgactgcacgcaagccatctagcgtcgccccttctcccgcgaggtaaaaggggcttcgcaacccggaagcgctctgcactcagctacacggccaaccagatacgacagtatccatccgctgccgcatcgcctcgttatcccctcttgcgcaaacggcggcgaatcaccagcaagctagaggccgcgacaacggctgtcgagaaaatcaccatatgaagcggcttgacctggaaaagataaggctgcaggtaagccagcccgacgatgactagatacaaaatggcaagcgcgatggcaatcgccagccccgctgccactacatgattacgcatgcccactcctttgagattccacccagcgctcgccagcgaagcggggcttggcaaaggcggaatgcccgcaatgcggtcttccaccctgaaaaattcaatcatcatatcactcaaccacaaaacaaaaagggcaagccccaaggcttgccctttctccatctgatggcggtcaaaccgccgatccaaccttacttcttgcgttgcggcggcaggtccgtgcaggtgccgtgcgccacttccgcggccatgccgatggactcgcccatggtcgggtgcgggtggatggtcttgccgatgtcggtcgcgtcgcaacccatctcgatcgccaggcacacctcgccgatcatgtcgccggcatgcgggccgacgatgccgccgccgatgatctggtggctttcggcgtcgaagatcagcttggtgaagccttcgtcgcggccgttggcgatggcgcggccggaggcggcccacgggaacacgcccttctcgatcttcaggccttgcttcttggcctcgtcttcggtcacgcccacccaggccacttccggatcggtgtaggccacgcccggaatcacgcgggcgtcgaagtaggccttctggccggcgcagttttccgccgccacgtggccttcatgcacgcccttgtgcgccagcatcggctggccgacgatgtcgccgatggcgaagatgtgcggcacgttggtgcgctgctgcttgtccacctggatgaagccgcggtcggtcaccgcgatgccggcgttttccgcgccgatcagcttgccgttcggcgcgcggccggtggcgtacagcaccaggtcgtagcgttgcgcttccttcggggcttgctcgccctcgaaagtcacccatacgccgtcttccttcggctccacggccacggtcttggtattcagcatgatgttgtcgaagcggtgcgcgttccacttctgccataccttgaccaggtcgcggtctgcgccctgcatcaggccgtccagcatttccaccacgtccaggcgcgcgcccagcgtggagtagacagtgcccatttccaggccgatgatgccgccgccgatgatcagcatgcgtttggcgacgcccttcagctccagcgcgccggtggagtccaccacgcgcgggtcgttcgggatgaacggcagcttcaccacgcgggagccggcggcgatgatggcgttcttgaacttgacgatcttcttctcgcccgactcttcgcggccttggccggtggtcagcgagacttcgatgtggtgcgggtcgatgaagtggccgttgccgcgcacgatttccaccttgcgcgccttggccatgccgcccaggccgccggtcagcttggcgatgaccttttccttgtagccgcgcagcatgtcgatgtccacttccggcttgccgaacttgatgccgttggcggccaggtggctcacttcgtcgatcaccgcggcgttgtgcagcagcgccttggacgggatgcagcccacgttcaggcacacgccgcccagggtggcgtaacgctcgacgatgaccactttcaggcccaggtcggccgcgcggaaggcggcggagtaaccgccggggccgccgcccaacaccatcacgtcgcattccacgtcggcgccgccgctatgggaggcggcgaccggcgcggcttgcggcgcgaagccggcctgggtggtggcggaggcgacgccggtggtttccaccggtttcacttcggccggagccgcggcggctgcgccggcggcttccaggatgacgaccacgtcgccctcggacactttgccgcccacggcgacgcgcacttccttgacggtgccggcggcttcggccggcacttccatggtggctttgtcggtttccagcgtgatcaggctggcttctttttcaatcacgtcgcccggtttgacgaacacttcgatcacgtccacgttgttgtggccgccgatgtccgggactttcaattcgatcagattgctcatggttttccatccgcaatgttgggaggccggcgcaaagccggccgcctcgagtctggctgattctgcagggtggaacctccccccgcatcctgcgacaagaaggcggaacgccccggccaagccgaggcttccgccccgccgttacaggatcagacggcgcacgtcggtcagcagcttgcccaggtgcacggtgaagcgcgcggcggccgcgccgtcgatcacgcggtgatcgaaggacaggctcagcgggcacatcaggcgcggcgcgaattccttgccgttccacaccggcttgatctgcgatttgcagacgccgaggatggccacttccggcgcgttcacgataggcgtgaagctggtgccgccgatgccgcccagcgacgagatggtgaaggtcgcgccttgcatgtcggtcggcttcagcttgccttcgcgggccagcttggacaggtcggtcagttcctgggcgatctggcgcaggcccttcttgtccgcgtccttgatcaccggcaccaccaggccgttaggcgtgtcggcggcgaagccgatgtggtagtactgcttcagcaccaggttgtcgccgtccagcgaggcgttgaagttcgggaaagccttcagcgcttcggcggcggccttgatgatgaaggccagcgggctgatcttcaggccggacttttcccattccttgcccacggtcttgcggaagtcttccagctcggtgatgtcgcactcgtcgttgaacgtgacgtgcgggatcatcacccagttgcgcgacagattggcgccggaaatcttctggatgcgggacagcggcttggtttcgatcgggccgaacttggcgaagtccaccttcggccacggcagcaggtccagacccacgccggagcccgccggcgcggcggccggggccagaatagccgggttctgcatcacgcccttgacgaaggccttgacgtcgtcttcggtgacgcggcccttgcggccgttgcccttcactttgcccaggtccacgcccagttcgcgcgccagacggcgcacggacggaccggcgtgagccttggagaaggcgatttcgtcgatggcggcggccacggcggcggctaccggcgccacggccggcgcggcggcaggcgcagctgcaagcggggtcggagcggccggggctgctgccggagccggcgcagcggctgccggggcggacgcggcgacagcgccttccaccacgacgatcaggtcgccttcgctgaccttgtcgcccaccttgattttcacttccaccacacggccggcggcggtggccggcacttccatggtggccttgtcggtttctagcgtgatcaggctgtcgtcgacggcgatttcgtcgcccactttgaccgtcacttcgatcacgtcgacgccgttatggccgccgatgtccggcacgcggatttcgctgcggccggatgcggtgggcgctgccggcgcgtcggccggagcggcggcaaccggagccggggcagcgaccggagcggctgcaggcgccggcgcggcggctgcaggcgccggagcggacgcggtagcgcccacttcgatgatggcgatcacgtcgccttcggaaatcttgccgcccacgacggctttcacttccttgaccacgccggcggcttccgccggcacttccatggtggccttgtcggtttccagggtgatcagggaatcgtccacggacacggtctggcccggggcgatgaatacttcgatgatgtctacgttgctgtgaccgccgatgtcgggcactttcagttcgatcagattgctcatgagctttccattcgtagggcggaagcccctctcggggcgttccgccggatatccgctacagattcgcttgccttgccaaaacggaagctcccggcctgggccggggcttccgttcaggaatcacaccttccagctcggcagcttgtcagtcttgatgccgtacttggcgatggcttccgccaccttggcgccgtcgatcttgccgtcgcgggccagggcggacagggccgccagcgccacgtggtagcgatccacctcgaagaaggagcgcaggttggcgcggctgtccgagcggccgaagccgtcggtgcccagcacgacgtagcggcccggcacgtaggcgcggatctggtcggcgtagttgcggatgtagtcggtcgcggcgatcaccgggccgttgcggccggccagctgctgttcgacgtaggaggactgggcctcggcggtcgggttcagcaggttgtggcgctcggcttccatgccgtcgcggcgcagctggttgaaggaggtcacgctccagatgtcggcgccgatgccgaagtcggccttcagcaggtcggccgcggccatcacttcgcgcaggatggtgccggagcccatcagctgcaccttgaccttggcgtcgccgccgtcctgcagcaggtacatgcccttcaggatgccctcttccgcgcctgccggcatcgccgggtgaacgtagttttcgttcatcagggtcaggtagtagaagacgtcctcttgttccgcgtacatgcggcgcatgccgtcctgcacgatcacggccagctcgtaggcgaaggtcgggtcgtagctgatgcagttcgggatcaggccggcctggatgtggctgtggccgtcttcgtgctgcaggccttcgccgttcagcgtggtgcggccggcggtgccgcccagcaggaagccgcgggcgcgcatgtcgccggcagcccaggccaggtcgccgatgcgctggaagccgaacatcgagtagtagatgtagaacgggatcatcggctggctgctgttggcgtagctggtcgccgcggcgatccagtcggccatcgcgcccggctcgttgatgccttcctgcaggatctggccgtccttggattccttgtagaacatcagctggtcatggtcctgcggcacgtagttctgaccctgggtggaccagatgccgtactggcggaacatgccttccatgccgaaggtgcgggactcgtccggcacgatcggcaccacgcgcttgccgatgttcttgtccttcatgatggtgcccagcatgcggacgaaggccatcgtggtggagaactcgcggtcgcccgacgcttgcagctgcgcgtcgaaggcggacagttccggcaccgccagcgggtggttgaccggattgcgggccggcaggtagccgcccagcgccgcgcggcgttcgcgcatgtacttcatttccgggctgtcttcggccggcaggtaatacggcacattcggcaggtcctcgtcggacaccgggatgccgaagcggtcgcggaagttgcgcaggctttccaggtccatcttcttggcctggtgggcgatgttcttggcttcgccggacgcgcccatgccgtaacccttgatggtcttggccaggatcacggtcggacggccgttggcgttgtgggtggcttcgtggtaggccgcgtacaccttgtgcggatcatggccgccgcggttgaggttccacacctcttcgtcggacatgttggccaccatctcgcgcagctccgggtacttgccgaagaagtgctcgcgcacgtagccgccgtccttggacttgaaggtctggtagtcgccgtccacgcactcgtccatgcgcttcttcaacaggcccttggtgtccatggccagcagcgggtcccaacgggagccccagatcactttcagcacgttccagccggaaccgcggaagtcgccttccagttcctggatgatcttgccgttgccgcgcaccgggccgtccaggcgctgcaggttgcagttgatcacgaacaccaggttgtccaggccttcgcgcgcggccatggcgatggcgcccagcgattccggctcgtccatctcgccgtcgccgcagaagcaccacaccttgcggcccatggtcttggccaggccgcggctttccaggtacttcaggaagcgggcttggtagatggccatcagcgggcccaggcccatcgatacggtcgggaactgccagaagtccttcatcagccacgggtgcggataggaggacaggcccttgccgtccacttcctggcggaagttgtccatctgctcggcggagaggcggccttccatgaaggcgcgggcgtacacgcctggggcgatgtggccctggaagtagatcaggtcgccgtcctggttttcattctgggcgcgccagaaatggttgaagccgacgtcgtacaacgtggcggaggattggtaggaggcgatgtggccgcccagctccagatccttcttgccggcgcgcagcaccatggcggcggcgttccagcgattgatcgagcggatgcggtgttccatctcgtggttgcccggcgacttggcttccttgccgaccgggatggtgttcaggtacgcggtggtcgcgtcaaacggcaggtgggcaccacggcggcgggtgcgctccaccagcttttccaacaggtaatgcgcgcgttccgggccttcgttatccagcaccgactcaagcgcttcagtccattcctgggtttccaacggatcgatatcgtcagggaaagttgcagccatctctggtcctcacagcgggtgacatcggggaccgcgtcgttgcaagccggccccgcgtttatgctattggctcggaatcgagccaaatatttgatttgagattataaacgaacacattcgcaaataaaaatgttcatttgcgaatgtgttcgctacgacccagccagtgtacgtccggatggattcgcaaaggaatagccggaagcgactaagacagcgggaagtcgtgaaaaaaaccgatgctgcgccgcgtcatgttgtttttttgcgataacacggcgcgaacttgaaacaattgtttcaattccgcgcagccttgcgctcgtccttggccagtttttccacctcgcgcagccgcgcctccagcatcgagcgcaggtagaagtcgtcgcccttggccttgctggccagctggtactgctccagcgccgacgaatagcgctgctcgtaatagaaagcgttgcccagcgcctcgtggtagcgcagcgggtcgcggtcggcgtagagcttggcctcgcgccggtacagcgccgggtcgccgctgcggtcgttcaattgctggcgcagcagcttctgcgcgccggcgcggtcgccgctgtccagcgccacgtcgatctgcgccaattgcagcgccacgttgcgcgggaaggcggccaggccgtcgcgggccgccgccgccgccgcgctccagtcgcggccgtcgcgggcgatctccacttccagcccgtgcagcatcgggttgtccagcagcttggcgcgcgccttggccagcgcctcctcggcgcccttgcggtcgtgctgcagcagcttggcgcgcgccaggccgtaccagctggcgccttcgttcaggtacaggccgcgctgcagcgtgctgttgtagtagaacagcgcctcttccggcgtcatggtcagcgtgcgcagcttttcgcgcaccagcaggtagtcgatgctgtcggcgcgcatccgcaccgggtagtcgagcgcgcggttctgcgcctcgctgatccgctccaccgtcaccgggtgggtgcgcaggaaggcgtaggccatggtgtcgctgtagcggcccgcctgctccagccgctggaagaaggtggccatgtagcgcacgtcgtagccggcgttgctcatgaactgcatgccgacgcggtcggcctcgcgctcgaaatcgcgcgagaacgccagctggcgcgaaatcgacaagcccatgccggccgacaccgcgcccatcgcgccgtcgccgctgccggctttggccgccagcgcggcggcgatgatggtgcccagcagcagcagcgggctggtggcgctgttggccgcctgcatccgcgcgatgtggcgctgggcgacgtgggcggtttcgtggcccatcaccgccgccagctcgccctcgctctgggtggccaggatcaggccgatgttgacgccgatgtagccgccgggcatcgcgaaggcgttgatgccggtgtcggcgacgcaaaaataggtgaaatggatgccgggcagcgtcaccgacgacgacagcctgccgccgatgtcgttcaggtaggcgctgatctcggcgtcgtccagcacgtcgccggcctcgcgcatcgcgcgcagcgcgtcgcggccgatgcgggactcgtcggacagggacagggaggcgtcggaaatctcgcccaggtcgggcaggtcggcgcggacggtcagcggctgcgccagcaccgaggccagcagcgcgcacagcaggcggcgtttcatcatggggcttatgatagccgcgaagcgatgaaagttgcatgcccgccagcttgatcaaagctaaacaattgttgcccgtccgccgcgctgtcatgacgggcggattccagctagactcgatcgctgtcgaggactcccgcacccaagccatgcccatccttcccgccgccccgccccggctgaccgccggcggccgcgccgacttcggcgtctatcagggcaccgtgtccgacctcagctgggacggcctggccatgagccgctggcagcggctgggccgccggctgcgccacaaacgctggcagtacgccgccatcgccggcgagcgcttcttcatcgcgatggcggtagtggacgtgggctggagcggcaccgccttcgcctacctgttcgaccgccgcagcggccgggtggtggccgctgccagcgccgacgcgctgcccggcgccggcccccgcgtcgccgatcgggcctttggtgacgcccgcttccgcgcgcccggcaagcgcttcgaattcacccgcgacggtgacgcgctgcggctgcggctggacagccgggcgctgcagctggacgcgacgatcgcgctggccggcatgccgccggtgctggcggtgatcgcgccagccaactacatggcccacagcacccacaaaagcggcggcctggcggtgagcggcgaggcgcgctgcgcggccggccgctattcgctggacggcgcaaccgcctcgctcgactactccaacggcctcttggcgcgcgaaaccggctggcgctgggccagcgcccactcgcggcgcttcggcttcaacctgcagcaaggctatatgggcgacgcggaaaacgcggtgtggctggacggccggctgttccgcgtcggcgccgccgccttcgactaccagcccggcgatccgctggcgccgtggcgcgtcgccaccgccgacggcctgctcgacctggtcttcacgccggaaggcgcgcggcgcgaggacaagaacctgatcatcgccgccagccgctacgtgcagccgataggccgcttcgacggcgcgctgaccgacccggacagcggcgagcgccacgcggtgcgcgatctcgtcggcgtcaccgaggaccatctgtcgcgctggtagactcttttaaagaaagcaaagcttgcgatgctgttgttgttgaaactgctgctggtgccggcgctgatcggcttgatcagcctggctgcgaaaagatgggggccgggcgtggccggcgcgctggccggctttccggtgatcaccggctccatcctgttcatcctgagcctggaacaagacgccgccttcgtgcgcgaggcgtcgctggccgccgcgctgggcaccagcgccaacctggtgttcggcatcgcctacagctggaccgcgcgccaggcgcgctggccggcgtgcctggcggcgggcctgctggcctacgcgctggcggtggcgctgggacactgggcacagccgtccggctggcaaagcgccgttttcggcgttcttttcctgccggtggcgggcaagctgtttcccatgccgccgcagacgccggattcgccgccgcgcagcgccggcatggcgccgcggatgctggccggcgccgcgctggtgctggccatcaccagcctgtcggcacggttgggccccagcctcagcggcctgctagcggtattcccggtgctgggctcggtgctggcggtgttcagccacctcagcgccggcccggcgacgacgatacggctgctacgcggcatggtgcgcggcttctacgccttcgtcgccttttgcgtcgcgctggccgctgcgctgagcgcctggcccgcgtccgccgccttcggcgccgcgctgggcttggccatcgcggtgcaaatcctgatgatgtggctgggacgccggcatcattgagatggcaaaacgccccgcggccaaagcctgcggggcgttgcgaaagccgcgggcgggactcagcgcgcgccgatgggcagcacggttcggccgtactgctcgttcagcaccgtggccatcgccaggtagatggcgctggcgccgcagataatgccttcgaaaccggcgatcatgccgatgacggcgctgccggtgaaatcgcgcgccgccagcaggaagaacagcacggtcagcgaggcgaacacgaactgcttcgcgcgcggatagttgacagtgcccagcagcatgaacagcgtgaacacgccccacatcagcagataccagcccatgtagccgaccggcgtggcgtcggccaggccggtcttgggcaagacgatcagcagcaccaggctcagccagaacaggccgtaggacaaaaaggcggtgacgccgaaggtgttgccgcggcggaattccatgatgccggcgacgatctgcgccaggccgccgtagcacaggcccatcgccaggatcatcgagctgatcgggaagaagccggcgttgtggatattgagaagtacagtggtcatgccgaagcccatcaggcccagcggggccgggttggccaatttttcgttcacggagcgctccaaaataagcaagcagtaatattcaaggaggcgcgattctaggcaagccgacgcggcgcggcaaggagattcgtcaaactctgtataattagaataaggacttaccccgcttgcaatcgccggcatcgcctccatctccagcgattcgtcggccgcgaatttttgtccgattccgccgactggtggtagcatgccgcccggaatagagtaaaacttccagagcgaattcacctgtgcgcccgctggacgcacaggtgaatccgtcccgatatccgcacaggaaaccgcacccatggaccgactgcataccctgctcgaacacaatcgcgccttcgtggaaaaccgcgaatacgagcaatacaaaaccgacaagtttcccggcaagggcctggccatcctggcctgcatggacgcccgcctggtggagctgctgcccaaggcgatgggcctgaagaacggcgacgccaagctgatcaagaacgccggcgcgctgatcacccaccagtggggttcggtgatgcgcagcctgatcgtcgccgtctacgagctgcgcgccgaggaaatctgcgtggtggcccaccacgactgcggcatgcgcgcgatcgacccgcacaagatcctcacccatgcccaggagcgcggcgtcagcgaagacaccatcgccacgctgcgcggcgccggcatcgacctggacaactggctgaaaggcttcgacaacgtcgccgacagcgtgcgccactcggtgaacaccatccgcaaccacccgctgatgccgaaagacatcccggtgcacggcatggtgatccacccgtccaccggccgcctggaagtcgtggtcagcggctacggcgaagagggcgcgccggccgcatgagcccgcgcatcggggtgttcggcggcaccttcgaccccatccaccaggcccacctccggatggctgccgccttcgccgacgaactggcgctggagcgggtgctgctgattcccgccggccaaccctaccaccgcgcgcgcggcgcgcgcgccagccccgagcaaaggctggaaatggtgcgcctggccatcgccggcgaccccaggctgcaggcggacgaccgcgaaatccgccgcggccgcccggcctataccgtggagacgctgcgcgaattgcgcggcgagctgggccaggacgccgagctgtggttcctgatgggcggcgactcgctggccacgctcgacagctggaaggactggacccagttgttccagctggccaacctggccgtcgccatgcgccccggcttcgactggcagacgctgccggccgaggtgcggcgcgagtggcaggcccgccaagtccatgatttttcaaatcgaacggcttccggtacaatccgctccctggctctgccgccgctcgatctgtccgccacccgcctgagggcccggctggcctccgggcaaacggccgagggcctgatcgacccggccgtgctggcctacatccgccagcagcggctataccaatgaacgggcggcggacaagccgccctcgctcttttgtggtacctcttgccggctcctgcgcctgctacgtaccggcacaggaaaaggaatcatggaaattcaagcaatcagcaaactggccgtcgaggccctggaagacatcaagggcaaggacatcatcgagctggacaccagcaagctcacctcgctgttccagcgcatgatcgtcgccaccggcgactccaaccgccaggtgaaggctctggccaacaatgttcaggtcaccctgaaggaagccggcgtggacatcgtcggcagcgaaggccacgagagcggcgagtgggtgctggtggacgccggcgacgtggtgatccacgtgatgctgccggccgtgcgcgactactacgacatcgaggcgctgtggggcggccagaagcccagcttcgccgccggcgccgccaagccgtggtcggcggtctgacacgctgacccgacaagggcgggcatcaggcccgccctttgtttttccatccgcacaagccccttcccgatgaaaatcaccatactcgccgtcggcaccaagatgccgcgctgggtggacgaagcctattccgactacgccaagcgcttcggccgcgacatcacgctggaactgaaagagatcaagccggaaaaacgcggcggcggcgtcaccgccgaaaagggcatcgccgccgagcacgaacggctgatcgccgccatcccgccgcgcgcgcggctggtggtgatggacgagcgcggcaagaactggacctcggtcaagctggccgaaggcctgaaagaatggatggccggcggcgacgacgtggtcttcatcatcggcggcgccgacggcctgtcggctgagctgaagcagcgcgccgacgtgctgctgcagttgtcggcgatgacgctgccgcacggcatggtgcgggtgatgctggccgagcagatctaccgcgcctactcgatactcaacaaccacccctaccaccgcgaatgacaaagccgcgcccaagcgcggctggattgcgcgccgcttcgccgcgcgctactgcggatgcttgcgcagcccggcgctcaagcggcgcctgctgtacggccacagcaagctgacgcccgccagcaccgccagaccgttggcggcgacgccggccacgtgcagatagctccaatggctgagcaaaccgccctgcagatggttgatccccagcagcagcgacaacccgcacagcagcgccatcaagcggtgcgcggactgcggctcctcatgcagcctgcacagcagataagtcgccagcaccagatcgaagatagcgatctcgcactgccagccgctggataggccccaggccgtgccggccgccatgaactgcggcgccagcaagtggccgatcgcgctggcgatggcggcaaacgcccaaatcctgacataccaagtgctcatcatgcccccttttttcgctattgaacgtgtatcgatacgctgcgccggcacgccggcgcccatttttagcacgcgaaccgcatcgtctttccgcctgggctccgccgctgggcggagctgacaggcgcgcgcatcttttatccacaacaaaccacgaaatccggttttatccacaagctcccggttcaagccgcccgccagacgcgcgagggtcggttgatcaacaggaccagtcccgcggccaacaggcatagcccccccgaaatcatcgtcgccgccgtatagctgcccaggctgttgcgcagcatgccggcgcccagcgccgcgaacgccgcgcccagctggtggccggcgacgatccagccgaacaccaccggcgcctcctggctgccgaaactgccggcggtcagcttcaccgtcggcggcaccgtggccacccaatccaggccgtagaacatcgcgaacagcggcaggccgaggaaatactccagcccgaaagcgtaaggcaggtatatcagcgccaaaccgcgcaggccgtaatagcaaaatagcaggatttgcggcgcaaagcggtcggatagccagcccgacagcgtggtgcccaagagatcgaacatgcccatcgccgccagcaggctggcgccgcgcaccggcgtcaacccgtaatcgccgcacatcgcgatgaaatgggtgccgatatagccgttggtgctggcgccgcagacgaagaaagtggcgaacaacagccagaaatcgcgcgaacgggcggcgcgggccagcgcgtcgaaggcgatgcggatcgggttgtggccaaggaccggcggcggcggcgcgtcgtccgcttcgcccagcgcgcgcaagcctatgctggacggccgctccggcaacagcagcgccaccagcggcatcgcgcaggcggcggcgatggccagcagccagaccgtgctgcgccagccatgccattcggtgaggtaggccatcaacggcaggaaggccagctggccggtggcggagctggcggtgaggatgcccatcgccagcccgcggtggcgcacgaaccagcggctgaccaccgacgcgcccagcgtcatcgcggtggcgccggtggcgcagcccaccatcagcccccacagcaactgcagctgccagttgctgcgcatcaggctggacaagcccacgcaaaccgccagcaaggccagcgccgccagcaccgtgcgccgcaggccgaagcgcagcatcgccgccgcggcgaacggccccatcaggccgaacagcgccaggttgatcgccagcgcggtggaaatcgcggagcggctccagccgaactcatgctccagcggcaccatcatcacgcccggagcggaacggatggcggcggtgaccagcatcaccaggaaggtgacggcgacggcgatccaggcatagtggaaacgcccccggctccagccgctcagaagggtcatgcgccacctcgtcgcttacgaaaacgcttttctcagactagcaacaaatcccgccggcgtcggctgccgccccgcttatccacagcgatggctgacttttcaagttacccacagcccgtcggcgcgcgccatgccatcgcgctgagccgcggccgcaccttgaatcccagccgctcgaaaaacggctcgcggccggccagcgcctcgcaatagaccacctccgcgccgcagcggagcatgaatgcccgcgccaatgccgtgcccagccccaagccgatgcaatcacgatgaacgacaatctcggccagccagcccgcttgccaaccatcgctgaaaccccgcgcaaaccccagcactcgcccgttgtccaacgcgcatacgccgaaacaggcgcggaacgcccgctccatcgcctgcagatcgaaagctttctcctctccccaaccttggctggcatataactccgccaccgctggcaagcaatgcgctggcaaatccgccagctttatccactggcaggtctcctcaatggacgctctgggctcgatctggtcagccatactccgcctcccccgccatctgacgcatgaaatccacgaacgccgccatccgggccgacagcccccgcgacgatggccacagcagccgcaacggcacccgctcgccgctgtcgctgttcaataaaggccgcaagcggccgtcgtccagctcgcggcggatggaaatgtccggcagacaggcgatgccctgtccctgcaacgcgaattccagccgcgcatgcatgctattgcagaccaacgcggccgatagcgatgtgtcggccagcggccaatcctccagcttgccgctattgggcgagcggtaatggatcaagcggtggtccgccaagcccgccggactccgcggactgccatgccgggccaggtagtccggcgcggcgacgatcaggcggcggaatcccggcaaggccaggctgcgcagcttgccgtcatccccctcgcccacccggatggcggcgtcgaaaccttcctcgatgatgtcgacgttgcgctcgctgtaatccagctccagcgacacctcgggaaagcgctgctggaaagccgacagctccgccatcatcacgccgcctatcgggggcaggctcaaccgcagcaggccgcctggcagcttgcccgcctgctccagctccgccgccatcgcggaggcttcttccaacatgcgccggccccggcccaacaccgcgtcgccctccgccgtcaaggccaatgaccgggtgctgcgttgcagcagccgcacgcccagttccgcctccagccggctgatccgcttgcccaccgccgacgccgacacccccagcagccgcccggcgccgacaaagctgccctgctctgccacggtgatgaacaccgccagatcgctcaatgaagccagcacatgctctccttttccaagcggcaagtgtagcgtcattcatgccaaatggttccgcaaagtgcggagcgccgcctggctgtttcccgcccccgccggcgcttaggctgacgctttgcttccacatcgagatcgccatgtcctcttcccgtctgctgagccccgcgctattgacgctggcggtggccgccttcgccatcggcaccgctgaattcatcatcatgggcttgctgcccctgatcgccgccgacctgcgcgtcggtttgccgcgcgccgcatatctggtgtcaggctatgcgctgggcgtggtggccggcggcccgctgctggccggcctgatcgcccgcctggacgaaaagcgcgcgctaagcgggctgatgctgattttcatcgcaggcaatctcgcctgcctgctggcgcccggcctatggccgctgctgctggcgcggatgttcaccgccttctgccacgccagcttcattggcgtggcggcggtgatggcggcgcggatggctccgcccggcatggccggccgggcgatggcgctgatgttcagcggcatgacgctggccaatgtgctgggggtgccggccggcacgctgatcggccagtgggcgggctggcgcgccagcttcgccgcggtggcggcgctgggcttccttaccttattgctgatccgctggcagctgccgacgcacatcggaaaccataccagcggcgaaacgcaggcgcgcttgcctggacgcgtctggccggcgctgctcgccagcgtcctggccgcagccagcatgttcgccttcttcacctacctagtgccgacgcttagccaggtcagcggcttggcggcgaagcacgccagcgcggccttgttgctatgcggcgcgggattggtgatcggcggctggctcggcggccgcttggcggacggaaacctggaccaggccctgtcgcgatgcctgatcctgctatgcgccacgctggcgacgttctacttgctggcagcgcgcctgcctttcgcgctggcgctgatggcgctatggggcggcctggctttcgccctatgcatgctgctgcaaacgctggccattcgccaggcgggagaggccgccgcgcaggcatccgccctcaatgtcggcgcctttaacctgggcaatgccttgggagcgtggctggctggaagactgctcgaccatggcggaaccttggcgcaaaccagcctgttggccgcggcgctggcggggctgacctggctgctggcgcggttcatttcacgcgtggaaaccgcccggcgcgtcgcactggcgcgggcatgaaaaaacgggccgcgcagcggcccgtcccaagaggaggcgaaaatcaggcggccagcagggtcgccagcgcccgcatggtctgccagggctcgcccggctccacgcccttgatctggcgatcgatgcgcgcgcactcggacaacgcctgcatcagcttgcgcgggccgatgcggcgcagcgccggctcggccagccgctgcttgtcgccccacagccgcagttcgcgcgccatgtcgcgcagctggcggccgtccttcaggccctggcgcagcctgagcagcatgcgcacgtcctcggacagcgaccacaacaccagcaccggcgcctcgccttcggccatcagcccgtccagcatccgcatcagccgcggcgcgtcgccggccagccaggattccgacaactggaacacgtcgaaacgggcgacattggccaccgccgcctgcaggtccgctaggctgagttcgcccttgggatacagcagcgccagcttgtcgacctcctggcgcgcggccagcaggttgccctccacccgctcgacgaagaacgccagcgcctcgctgcccagttgctgaccctgcgccttcagccgccgcgaaatccagcccggcagttcggcgcggcccaccgggcgcgcctccaccgccagcccggccttttccagcgcggcgaaccacttgccctgctgctgggtcttgtccagcttgggcagcgtgatcagggtgagggtgtcggccggcgggttggccgccagccgctgcagcgcctcgctgccctcggtgcccggcttgccgccgggaatgcggatttccagcagcttcagcgaggcgaacagcgacacgctgctcatcgcgtcgaacagctgcgaccaatcgaaacccgcctccaccgtcagcacttcgcgctccaggtaaccggccgcgcgcgccgccgcgcgcacggcgtcggcggcctccagcgccagcagcgcctcttccccgtgcaccaggtacaacggcgccagccccttggccagcgccgcggtcaacgcgtcagggctgagtgacggcattggccggcttcaagctttgcggaccggccggcgagacagccggcactttcaggtaggccagacggcgcacgatctgctcggcggcgtcgcggcgggcatcggcccacagcaggccctcttcctgctctttgcccagcaccgcgctatccgagtaattcatgctgcggcgcacgctcacctccatgtccggctcgatcggcacgccgcccagcaccacccgcacggtggcggtgtaggtcagctggtactcgctgatcttgccgctggcgttgatggtgaggatgtccttggactggttctcgttgagcacggtaaccaccgcctgcgcctgcttggcagccggcagcagcgtcagcttcgaattgcgcgccagcaccgtgcgcaggtccgcttcgatgccggtattggccgcctccagatacatggttgagaacggcagctccttgacgctgccccccaggccgcgcaggtggaagccacaagcgctcagcagcaggaccaagccggccaacagcaggcagttcaggctttgtttcatatcactccccagatggcggatgctccgccggcaaaaacggcgcgggacagccccgccgccccgcgccgcgtcttcgctcgaatcaaacgacgatgttcaccaggcggcccggcaccacgatgatcttcttggccggtttgccttccatgaacttgatcacgttctcgtgcgccagcgcggcggcctcgatcgcgtccttggcggcgtcggcagccacggtgacgctgccgcgcagcttgccgcacacttgcaccatcagttcgatctcgctcttcaccagcgcggcctcatccaccttgggccaggactgggccagcagctcggtgcccggcttcagctggctccagatgccgtcgcagacgtgcggcacgatcggcgacagcagcagggtggcggcttccagcacttcctgcgccaccgcgcggccggtgtcgccactggtgtcggccttgtcgtaggcgttgagcagctccatcaccgcggcgatggcggtgttgaactgctggcggcggccgtagtcgtcggccactttctggatggtgccgtgcagcttgaagcgcagctccttctggctggcgttcagctcgcccgcgctatacggagcgaccacgccggcctcgacgtgctcgcgcgcgctcttccacaggcgcttcaggaagcggaacgcgccttccacgccggcgtcggaccactccaggctctgctccggcggcgcggcgaacatcatgaacaggcgcgcggtgtcggcgccgtatttctcgatgaactcctgcgggtccacgccgttgttcttggacttggacatcttctcgatgccgcccaccaccaccggctggccgtccacgcggtgcgtggccgccacaatcttgcccttggcgtcgcgctcgaggatcacgtcctgcggcgcgatccagtccttggagccattgggcaggtcgcggtagaaggtttcgcagatcaccatgccctgggtcagcaggctcttgaacggctcgtccgacgataccaggccttcgtcgcgcatcagcttgtggaagaagcgcgcgtacagcaggtgcagaatggcgtgttcgatgccgcccacgtattggtcgacctgcagccagtaatcggcggcctgcttgtccaccatcgcggtgtcgcacttgggcgaggcgtagcgggcgtagtaccagctggactcgacgaaagtatccatggtgtcggtttcgcgcttggccgcgccgccgcacttcgggcaggcggtttcgtagaattccggcatcttggccagcgggctgccggcgccgtccggaatgacattttccggcagcgtcaccggcaggtctttttccggcaccggcacgtcgccgcagctggcgcagtggatgatcgggatcgggcagccccagtagcgctgacggctgatgccccagtcgcgcagccggtattgggtcttcttctggcctaaacccttatcttgcaacttagagcaaattttctcgaaagcttcagaagaagtcagtccattaaattcgtctgattggattaatttgccatgctcagcaaaagaaggctgccattcatcccaagaaattctgtgttccactactaggttattcgctctgcgaataactgggaatctaaacgggacaccattttcaccattagacgccccaccaacctctgcataactgacgtttacatcatcaacatttttctcattcagaactaccggcttaatcggcaacctgtatttcttagcaaattcgaagtcgcgctcgtcgtgcgccggcacggccatcaccgcgccttcgccgtagccccacagcacatagttggccacccataccggcaagcgttcgccggtcagcgggtgggtcacgaacaggccggtcggcatgcccttcttttccatcttggccacgtcggcctcggccacggagccggacttgcattccgcgatgaaggcctgcagttcggcgttgccggccgcggcctgggtagccagcggatgctcggcggcgacggcgacataggtggcgcccatcagcgtgtccggacgggtggtgtagaccttcagctcgcccttatggccgatgctggcctcgtcgtacgggaacaccacgtcggagccgtagctcttgcctatccagttgcgctgcatggtcttgacctgctccggccagccgtccagctggtccaggtccgccagcagctgctcggcgtagtcggtgatgcggaagtagtacatcgggatttcgcgcttttccaccagcgcgccggagcgccagccgcggccgtcgaccacttgctcgttggccagcacggtctggtccaccgggtcccagttgaccacgccgttcttcttatagatcacgcccttctcgaacaggcgggtgaacagccactgctcccagcggtagtagtccggcttgcaggtggccagctcgcgctcccaatccagcgcgaagcccaagctgtccagctgggtcttcatgtattcgatgttggagtaggtccacgccgccggcgcgccgccgttcttcatcgccgcgttctcggccggcaggccgaaggcgtcccagcccatcggttgcagcacgttgaagccctgcaggcgcttgaagcgggccagcacgtcggtgatggtgtagttgcgcacgtggcccatgtgcagcttgccggacggatacgggaacatcgacagcgcgtagtacttggggcgggaagcgtcttcaaccgccttgaaggcggcggttttctgccatttctgctgcgcggcgctttccagctcgcgcggggagtagtgttcttgcatgtccggagtctttttattcagtggaattcgagtcgaatggatcgattatatcggcaaaagcggcaaaaaggggatgccgcggagcggacaggctgtccgatttccgtacaaaaacaaggcgttcatagcagccggagcagcatctcgctggccatcgccgccatcagcaaggcaaacgcctttttcagcctggccaccggcagccggtgcgcggcccgcgcgcccagcggcgcgcacagcaccgtcatcagcatcaaggccagcatcgccggcaaataaacaaagccgacgctgccccagggcaggccttgcgcgcgccagccgctggccagatagcccagcgcgccggaaacggcgatcggccagcccagcgcggcgctggtccctatcgccgtatgcaccggcacattgcaccagctcatcaacggcacgctcatcgagccgccgccgattcccacccagctggaaatcatgccgatggcgccgcccgccgcgccctggccggcgcggcccggcatctcgcgcccggccctgggctgcttgcctatcagcatttgcgccgccaccgcgtaggcgtagaccacgaaaaaccaggccagcgcgcggccgggaatccagcccgccagcaggctgccggccagcgtgcccagcaccatcgccggcgccatgccgcgcacgatgcgccagtccaccgcgcctttcttgtggtgggcgcgcacgctggaagcgctggtgaacaccatcaccgccagcgaagtgcccaccgccagatgctgcgcgtgctcgccgcccagatgcgcggccgccaacaccgccagcaccaccggcacgatgatcagcccgccgccgacgcccagcaggccggccaggaagccggccaccgcgccgcagcccagcaaggcaaccagcaagggcggcgccagcatcacaacacctcgcgcgtgagatagtcccactcttccgccgtcaccggcgtgatcgacaagcggttgccgcgcttgagcaccgtcatgccctccagcggcggatggccgcgcagctcggccggcgacaccagccgggtcttgctgacgaagcgcacgtccacgcactgccagcgcggctgggccgggtcggacttaggatcgtgataggggctgtcaggatcgaactggctggagtcgggatgcgccggcgcggccacttcggcgatgccggcgatgccgggctcgggacaagacgaatgccagaacagcagcaggtcgccgggacgcatgtcgtcgcgcatgaaattgcgcgcctggtagttgcgcacgccggtccactcgaacaggcgcgccggttcggcggccaggtggtcgatcgaggtttcgtccggttcggacttcatcagccaatagcgcatgggcaatatctgttaatcgctgaggggaaagggaaagacttgctcaatcttactggaaagattgcctcgtatgctggtttcaacaggacaggttttttgccatgcctgccgttccaggagaataccgatgaaaacgtggatactcgccgtaatcgcgataggcagcctaagcggctgcgtggtggaaccgccgcgagtgggcatcgcaccggtagtggtgcggccggcggtggtggtggcgccggcttactactacggcccgcgctactacggctggcgttgaagccaccaccatgccagcggcggcgccagattggccagcgccgccagccaatagatcagcaggaaaggctgcttgcgggtcttgtggcggaaccagcgctgcgcgagaaacgcggccggccagccgccggccaggtgcagcagctgcagcctggcctccggaatgcgccaggcgccgcgcagggcggcgcgcttgtccagccaatacgccagcagcgtcggcaaggccagcgcggcgtaaggcagccaccagccccagcccagccgccccagcaggcaggcagccagcaagggcagcaacagcagcagaatcatgcttccgcctcccgcagcggcagccgccgcaggccggactcggtcagcaggcagtccagccgcacatcccaggcctcgcgcggcaccgcgtccaccagctggcaatcgaaagccacgccgaccagcagcggcccgccggcggcgacgcggcggcggaaggccagcgtgctgtcgtagaaaccgccgccctgccccatccggtaaccctcgcggtctacgcccagcaagggcacgaacaccacgtccagccgctcggcgcgcagccgggcgccggcgtattccaggatgcggtagcgcgggtgcagataccagcggtcggcggccgccagccgggtgaaccacagccggcggccgcggcgcggaatctgcggcagatagacgcgcgcgccgcgccacagcgcggcgttgagcagcatggccaggtccagctcggagccggcggccagatagcctcccacgcgcttgccgcgcttcaacaggcgcgaagcatggcgggcgatggcctgcgccgcggcggcgcgataagccggcggcaaagccatgcgggcgcggcgcagctggcggcgcagcgtcggtttgtctgtaatggggagaatatcggtcatgggagggggagacccccgcgagtgccgttcgggctaaattcgcttgtaccctgtttccaggatgggccgcctgccagacatttcgggcgcgttctcaaatggaacgcggcacgcccatgtctcacgctggcagccagaagcgaacgcattggtacaaaggaattgtgtgccgtcacgagcaccgcaggggataaactgacctgtagtgcgagcctggaaccggctgtcagaacagcggttgctggctctggcgaagcgcgttgtcggccgcttcgcccatgtcgcgtatcttacgctgaaacgccgccatctccaagccctcgcccacttttgttttcagcagatcgtgggcgatgttgagcgcggccatgatggcgatcttgtcggcgtccatcaccttgccgtgctgctgaatggtggaaatcttgccttccagcaggcgcaccgcctccagcagggtttcctgctcgccctgcggggtgccgatggtgaaatgacggcccaacagttcgatctcgacctgaaccacgtcgctcattgctcatcctccggcgcgcccggcaggcgcgccaccagggccgccacccggctgcgggtttcgttcacgcggaaattcagctcggcattctccttcagcgcttcggacagcgcctcggcaaagcggccgttctgggtttccaactcccggatgcgggcgatcagcgccgcgacgcgggattccagatattccagttcattgtccatgccggcgaggataacgggcggctagttgggcgtcaaacccagccgctggcgcgccatgtccagccgctcgcacagcgccgccgcgccctcgaccaggcgcgggccgggaatgctgatgtcgtcacccggcagcgcgaacagcgcggcatgcgacaccgccggcacgccgcgccagcgccgccacatcgccagcgtcgcctcgtcggacgccactatcgcctgtggctgcgccgccacgaccgaggcggtggatacctgcggcgccggcagcggcaggtcggcgaacacattgaccccgccgcaagtgcggatcagcgaatcgatatagcttttgccgctgatggtgaagatcggcgcctggctcagctggtagaacacccgcaccggcgcgcggccgccgtagcgctgctgcagcgccgccatttgccgccggtattgcgcggcggcgcggttggccgccgcctcgctgccggccagccggcccagcttgccgatttccagcgccacgtcgcccggctgcagcggatggctgatgaacaccggcacgcccaggctgcgcagacgcgccagttcgcgcggggtgccgccatccttccaggccaccaccaggtcgggccgctggcgcagcaccgcctccaggctgaagccggtgaagctgccgacccgcggcagcttcttcgccgccggcggatggtcgctgtattcgacggtggccaccaccttgtcgccggcgccggcggcgaacaagagctcggtggcgtgcggcaccaggctgacgatgcgctgcgccggctgccgcagcgccacttcctggccatcgccgtccgtcacacggatatcggcctgcgcggcgccggccagcaacagggcggccaagacccatgcgcgcctcatgccggaccccctttcaaaaccagcggcaaaccgcaggccaccagcgtcacccgctggcagcgcgccgccgccagctggttgagccgccccagttcgtcgacgaagcgccgggtttcggcatctccagccaccacgccccagcccacctcgttgctgaccagcaggatttcgccacgcgcgccgtccaaggccgccagcagggcgtcgcgctcgacggcgtagccggcttcgtcaaagcctggttcaccgaaaaagcgcatcagccacatgcccaggcagtccaccagcaccagcccgcccgggcagtcagcggcggcgatggcggcggccaggccgcggccggcttccgccacccgccaatgcgccggccgctgcgcgcggtggcgctccacccggcgcgcgaactcggcgtcgcgcacttcggcggtggcgagataacacaccgggccggcatggcggcgggccaggtcttctgcatgggcgctcttgccgctgcgggcgccgccgctgatcagatggggcatggtttagaacgtgtaagtcacggcggcttggtaattccgcgcgttggccgggtacaaatcataagccgtaggcgaggtgtaagcatccgtcccgccataggtcgcataatgcctgttgaacaagttgttcacgctgaaagtggcgctcacatgcttgccgaatgcctggctgaacttggcgtcgacaaccgtgtaagccggcaacttgcggccaaaggcgttgctctggtcattatcgaaatactgctgagaaacatattgcgccgccaccgacaccttgctggcgtcgctgatgctccaattcactgcggtattcgccatcagcttcggcaccatcggaatagtgttgccggccaagccggcgcctgagcggtaggtcgcctgagtccaggtcagattggcgttcacgcccacccgctgcgacagcttggcgccgccctccagctcgacaccctgatggcgcgtctccggcaagttggcattggcgccaaacagcccgacgaaggggttgtaagcgatttcattggtcagatcattgcggaacagcgccagcttggcatgcgccgcatcgttcgcccattgcgcccccacttccctatcatgcgactgctgcggctgcagcggcaggccgttggtataagtcacctcatcggcattgcccaggcggaagctctggccggatctggcatacacgctccaacccgcgcgcaaatcctgcttcaggcccaaggaccaggcatgcaggctggtatggatggtcgacagattggccccgccgctcatggcgttgaccttgtcgtccaccagttgctggcggcctccggccgacagcgtcgcgccctgccacagcttgaactggccgtcgacgaaatagccgacgcgcttttgcgaggtctgcttattgcccagcgagttgtatacgctcatcgaactgtcgagccagtcgctgccgaaagacagggtgtgcttgccgataggcagctcgtaacgggcgctggcggcgttttcgcccagattgcgctggtcccgcgagcatccggcgatgccggcatactggacgcaggagtccgcatccttgacgcggcgcgaccagtcggcatacagcgtcccggcccccaagtcctggctcaaagaaacgccgccgctgctggtgccggtggaggagtgactgttcggcgtcgccgtgccggtcggattgttgagcaaggggttctggccgttggccggatccatgacgatggatcccggcaggcgcaagccctggctcgccgttttggcgaacagcttgatgtcgccgccgtcatgcttgaaagtcaaggtggcgccggcgttgtcgtcgcgctcggcattgttctggcggtaattgtcggtcttcaacgactggacatagccatccagcgccacatactggttccccgcgtgcagattggcatccagctggcgcagatcgtaactgccgccggtcagcatgacgctgccgttcaccccgttggccgcgccggacttggtaatgatgttgatcaccccgccggtcgcgccgccgccgtaggcgacgccgccgatgccgcgcaccacctcgatgtggtcgatgctcgccagcgtgaccgcccccaggttaggcgcgctcaaatcattggtgttttgccgtacgccatcgaccaggatcagcgtgttgctcatgcccgtcacgccgaaacctcgcaagtccaccatcgccgtgctggcggagccggaactgttcgacacatgcacgccggcgtagctagacagcacatcctgcaccgtcgtcgccgtgctgttggcaatgtcctcggcggtgatgacggtgacgttcgccggcagcgacgagactttctgcggcacccggctggcggtgacgatcaccgggtcgccggcgaactcgggaagatcggcggcctgaaccacgccggcggcggtcagcgccgcgaacagcgcgcaggattgaaacttgaacatgaaacacactccacgacagggtcaacgttgagtgcgaagaggacaacagcagcaaaggacggcacggcaaaaccggaacgcctgtcggatcgcctccccgcgattcgtcagcaatctgcccggcttccggccgaggcgcgcaggccggtctccgggctgggccatgccggcgccgcgccttcccgtccaaaggacagtggctatctgcgtcgcctgggcgcttgcgcgccgggccttaccgttgcgggggcagcgccggcttgtccaccggcttcccgtttcacccgcgcgccggaattcggcggccgcgggcacctgcaagcggcggattatacctcgccgggcttatggcggcatcgtccaagcggtaatatgcttagagtccgaccggccgcgcgccggcggcaggctttttctcgatcacccgggcatcgcgccccgcactccggcaggctcaaccatgaacagcagcaaacccctggatctctccgcccgcaacgccgcccgcgcccgccaggccgtgctcaccaagccgcccggcagcctgggccagctggaggaactggcttgccgcttcgccgcctggcagggacgggcctgccccgaggaattgaaaccggcgatcaccgtgttcgccggcgaccacggcgtcaccgtcgaaggcgtgtcggccttcccggccgaggtcaccaccgaaatggtgcgcaacttcagcgccggcggcgcggccatctgcgtgctggcgcgcgcgctggacgcccggctggaggtcgtcgacgtcggcgtggcgggcgatgtgtcggcgctgcccatcatccacgccaaggtgcgcgccggcagccacaatctggccaaacagtcggcgatgagcgccgaggaaaccgccgccgcgctggaaaccggccgcgccgccgcgcgccgcgcggtggatgccggcgccaatctgctgatcgccggcgacatgggcataggcaacaccaccgcctccgccgcgctgatctgccgcctcaccggcgcggcgccggagctggtggtcgggcgcggcaccggcatcgacgacagcggcctctccaacaagcgccgggtggtgaaaaccgcgctggcgcgggtggcctgggaaaacctcagcggcgaggacacgctggccgaattgggcgggctggaaatcgccgcgatcgccggtttcttcctggaaggcgcgcgcctgggcgtgccttcgctggtggacggcttcatcgccagcgcggccgcgctgtgcgccaaagcgatagacccgacgctgcacgactggctgctggccagccaccgctccgccgaatccggccacgacctggcgttggcggcgctgcagctgcacccgctggtggacctggggctgcgcctcggcgaaggctccggcgcggcgctgtgcgtgccgatgctgcagatggcggtgaagctgcacaacgagatggccactttcgccgaagccggcgtcagcggcaaatcggcatgaatccctacacgctcaccctgctgcgccacggcgaaatcgaccacgacggccggctgatcggcctgaccgacctgccgctgaccgagcacggccaccatcagctcggtcgcagctggcagcgcatcagcagcctggcgccggtcaccgccatcgccagctcgccgctgcagcgctgccgcgaattcgcggtcaagcaggcgctgtccggctcgctgacgctgaaagtggacccgcgcttcgccgagatggacttcggcggctgggacggccagccggtggccgacctggagcgcgtccaccccggctggggcgaagcgctggccgacggcaggctgagcccgcccggcggcgaaagcttcgaagcgttccgcacccgggtgctggccggcctggccgactggatgaccgaggcgcgcggcagccaccggctgctggtgacgcacggcggcgtgatcactgtgctgatggcggaattgctcggcaccgatttttccgtcgccaagctgatgacggtgcagcgcggcggcttcgtccagctgtcgatgctggaaggccacccggcctacctgctgcgcctggagtctgcatgcgcggactgatcctggcggtgcagtttctcacccggctgccgacgccgcagttggcggaattcaagccggaatggctggccgccagcgcgcgctggtttcccgccgtcggcgcgctggtcggcgcgctgctgctgggcgcgctgcaagtgggccagccggtcgacccctggctggcggcgctgctggcgctgctggtctggaccggtgtcaccggcggcctgcacctggatggcctggccgacctcgccgacgcgctgggcgcgtcccaccgctcgcgcgaacgcttcttcgaggtattgaaagacccgcatctgggcagcttcggcgtgctctcgctgatcctggcggtggtttgcaagctggtgctgctgatgctgctcgcgcgccagagcgggccggtctggggactgctgctggcgccggcctgggcgcgcggcttcgccatcgcttggtctgcgacgctgccggccatcgcgccgggcagcggcgaacgcttcgcctggcgccgcgactgggccggcatggggctgaacctggccgcgctgctggcgctgtcggcctggctggcgccggcgctgctgctggcccccttggccggcctggcctggtgggccttcctgaagcgccgcctgggcggcatgaccggcgactgcctgggcgcgggggttgagctttgcgagatcgcgctgctcgccgcgctgttgattctgccgacgtattttcctgtgttgaagtgaggccggcttacggcaaacgcggcgtcaaaacgcctgggtgctggcgcaccaatgcccacggcaacaggctccaggccgggttgtcgcaatccttccgcgcgcgcgcgaagaaggcgccgatctgcatgcctttcggcgtcagataccaattgaacgcattccaggcctcgggaccgcggtaatcgcaacccccgccttcgccaccagccatctcccgcggatacaacttgccgaagacgctagcgagccaaggctgcagcaccttgctttcatacccggcatctcgcagcaggccatcctcgccccgcgcatcctgtggttcgcccctccccagccacaatacatcctccagatgcaaaacgcgcccgctggccacctccatattcaacggcgcgtcgccggagtccggatgggcgccgccgcaaaacgcgctggtttcaatgctgatgctcaccacgcgcggcgtcagcaagcgcggggtcaccgcctgctgatacctgcctaaagtcgaaccctgcgcggccgccacgcactcgaaggcatccaccaccgcgcgccattgccgcctctcaaaaatccggttcagacgggccatggcgtccgcagaatagccgctttccaaccggaaccagcggatccggctgaccggctcctcccaccagctcagccgatggccgaggaaaacctgttcgcccacccgccgcaaccgcaggtcagccaatctggcccggttgtagtcgtcgatccaatccgcttcgtccgtaccctcctcgctcgacatggccaacggcgtcagcgtgaccggcaacgcgcgcttcgtcttcggttcgcgccactcacccacccaaccggttccggatgggcgcaacgcgagatcggcccgcgcctcgccatggcccaggctctcgctcaagcgcaacgcgccctgcgcatcccgcttgcccgtcagcgcgatgtcattatggaatttgcgatagaaataacggccgtcgacctcgccctcgttatcgacgctccactccatcacaaccggcgcgccgcccaactcgccctgccagacatcggcgtgaaccggcgccgccaaagcccagctaacccacaaaccaaccgcttttcgtacgtccatgccgcccctttgcatgaaaaagcccgcccaaactcagggactggtgccgctctccaagcgagagtgcgtcacaaccacacaagcacttttccataatgacaatttcatagcccgtcacccatctttcacagccgacggctcaaggctgccgcgccccgtggcgcggaaacccgcagcgcgccgggatgagggaagtcgttcaagtccggcgcaaagcgccggcgcgcgccctggccgccgtcaagccgatccgccaccagcgccagcgcagcctgacgtcgtaccaggcgggcctgagacccagcaggaacaggaacaaggccagcggcagcgtgaagccgaaacccaggtgcttgaagcccagcgcgccgaccacgccgccggcgaagaaggacaacaggatcaggctgtagacgcggaatttgttgcggttggatcgcaccgcctggatccgtggcccctgctggcggttgtagtagctcatcttggccagctcgatgccgatgtcggtggcgatgccggtcatgtgggtgctgcgcagcaggccgccggacagcttggtgacgatggtgttgtgcatgcccatgatgaagcacaacaacatcaccgtcggcggcgtgaacaggcccttgtgcaacgacaagccggcgcccagcaagccgaacaccagcagcagcagcgcctcctccatcatcgacacgccgtagccgccgcgcagccgttgccggcgcgcccacaggatcagccaggtgctgtgcatggcgccgccgatgaagcagcacagcatcaccagcagcgaaagcgccagccgcacctcaccggtgccccaggcgtcggccatgccggacacgatgccggagacgtgcgaggtatagcggtgcaccgccaggaagccgccggcgttgatggcgccggcgatgaaggccatcgcccagcccagctggcgcaataccttgtcgttgaagcggccgcggtccagcagcctggtaatgtggaagtgtcgggccatggcaatccggcaagcaaaacggcgacccatcgtcgccgtttttcatattgcgccgcagcatgcccgcttggcaagccgtcggatcaaatgccgtccaatcagcagcctttcagcgcgatgcccggcgtcaaccgcttctgcagcgccttcagatgctcggcctgcgccgcgtccaggtctttgaaggacagcgtggtcaccttggccgcttcgttcttggacttgaccaccgccttgtcgtagccggccgccttcaggcgcgccgccagcgtcttggccgcgtcttcgcggccgaacaggcccagcgacagattgcccttgaactcgtcgccgctgacgaggtagttgtcgaaacccttgtccttcagctcggccgacagcgtcttggtctcggcctgggtggccagcggcgggtagtacacccagaagcggctcgagcccttgctttcttccttgctgtcttcctgcaattggccagccttcagcttcagcaacggcacgccgcccttcacccgggccagcaggctgtcgctgaggccggcccagcggtagcaggccttggcggccggcggcgcggcttccgcggacttggccgcggccggtttggacgcctcttgcttggccgccggcttcgcctgcgccttggccgatttggcctgttcctgcggcgcgctcgccgcgggcttggcatgtttgtccgtcttggctgccgccagcggcgccgacgccgccttggcggcggacgcgggagcgctcgccgccgcatgcggcgcgctggcctgcccggccgacgcgtccggcgtccagcctgtcggcaacagtttcacctggccgggactcacttcctgcgcatgcacatccatcggcggccgctgcttgaaggagccatacatggccaccaccagattcagcaccaccaccagcgccacaagccacttgatcacgcgttcgccaccttgagtaaacccatcaacaccagattatccacgatctccagcggagcggcgagccaaggcgcgatgcggccggcgtcgcccccggtcaggatcaccgtggcaggctggcggccggtgcgttcggccagcttgcgccgttgcccttcgatggcgcccaccagcgccgccatcacgccgctggccaacgcatcctgcgtaccttgcgggaaatccaccaccgcgccggcggcgcgatcgagattggccgtgccctgggccaggctttgcagcatcaggccatagccgggcaagatcagcccacccagataatcgccgtcggcggtcagcgtttccaccgtcaacgccgtgccggcgcaggcgacgatgacgtcgccgccgcacagttcgcgcgcggccaacaccgccagccagcggtcggcgccctgctcggcggtgttgcgataatggttacacaccgcgccgaagcggctctgggcatgcacccggtgcaaggggcaggccagcgccgccgccagcgcgtcggccacttccttccgcgccaccgacgacatccaggcgccctgcagcggcagttggctccagaccggcgccaggctggccagctcgccatgttcggcggcgcctttggccacgcattccgcgccgcggtaggcggcccatttcacccggctgttgccggcgtctatcaataacttcattggcgttccctgagactgacctctccgacatggaaggtccgcatcccctgcgcggtctccacccgcagggcgccgttgtcggcgacgccgcaggcgatgccgtccaccggctcgccgtgggaaaaactaagccgcaccggcgcctgctgatgcgcggacaacgcgcaccactcgtcgcgcagcggcgcgaagccgtcgcgatcgaacgccgacagcaccgtttgcaattcattgagcagcgcggccaacaggctgttgcggtcggccgccacgccggcctggcgcaaggtcgccaccggctggtccacttcgcccggatcggccacgttcaagcctatgcctatcaccaccgccgccggccccagcgcgtcgccggacagctcgatcaggatgccggccagcttgctgccgtccagcagcacatcgttgggccacttcagccgcaccggcgcgcccaggccgcgcagcgcgcgcgccagcgccacgcccaccgccagcgacaagccggccaactcggacacgccgcgttcgaagcgccacagcagcgagaacgtcagccccgatcccaagcgcgcctgccagcgcctgcccagtcggccgcggccggcggtctgcaattcgcaggccagcaccaggccatgcagtccgccgttgccggcgcgcgccatcagctggctgttggtggagtcggtgcgttcggccaccgccaaggtatagacctcggccgcggcttcggacaggccggcgcgcacgccggcgacatccagccaggcgaacggctgcgccagcttgtagccctggccgcgcacgctgaacacggtgaggcccaaatccgcctctatcgcatgcaccgcctgccacaccagcgtgcgcgaacagcccagcgcctgggcgatgtcctcgccggaatggaagcgcccatccgacaggtggtgcagcaccgcgaacgcgtgttcgttcacgccttgccctcgccggcgcggatcttattcaaggtctgggtggtggaggtatcgaacaggaaggggatggaatgcacctggccgccgcgcgccagcgtctcggcgctgccgacgatcttgtccaccgtccagtcgccgcccttcaccagcacctccggccgcacctgctcgatcagctgggccggggtgtcggcgtcgaaccaggtgaccaggctgacgctctccagcgccgccagcaccgcggcgcggttatgctcgttgttgatcggcctgtcctcgcccttgccctggcgcttcaccgaagcatcggtattcaggcccagcaccaggctggcacccagcgcccgggcttgcgccaggtaggtgacatggccgcgatgcaggatgtcgaagcagccgttggtgaacaccaacgggcgcggcagcgcggccagacgctccgccagctgttccggcgggcagatcttgtcttcaaacgacggcatcgggtaagtcatgcggttccttgcgcgaatcatgcggcgcaggcggcagacaaggccgcggccgcaaatgggacgagtcgcgaagcataccaccgtcgcccgcgcctgcccaactcccgcgctcagggacagctcaggctggcgccgctcagcgtggcgccggcgctggcggccgactgggcataaccggtgctctgcagattgaacgacagggcgacggcggcgccgcggctgtcgcagatgcggaagtcgccggtctgcgccaccgcgacatagggcgggcgcggattgaagctgacgctggcgatggtgccgctggcggtgcccgccgccagcgtgcctatggtgggggaaccggaaaccagcggctgcgatttcagcaacaccgcgctgccggactgttgctcgcttatcacccagccggcgctccagctgctgccgcacgccgtgctggaagccgcgctgtacggacagatggtgacgacgctgtcgtcgttcaccgccgacgccctggcctggctcatcgcgctgagcagattgtcgcgggtgctgatcagccgctggttctgcatcagcgtctgccaggccggcatcgccaccgtcagcaatatcaccatcaccgccagggtgaccatcatctccagcaaggtgaagccgcggctgttgcccgacatgcgattccccagtcaatgcggccagcaggtgctgctggtatcgctgccctgcgcgttggccgcgctgcgcaagccgctgttgctgacattgaagctgctgcaggtggtgtcggccgcctgcagtccgccggcggccggcgtggcggtcagcacatagccgctggccgtggtggcggaagacacctgcacctggtaatagccgccaggcgagctggccgacaccgtgcaggcggcgttgttgtaagcgaaatactgggcgtagcactgctccatctgcgactgcgcggcggtcagcgcctgccaggcgtcgccgcgccgcgattgctgcacatggctggtgtacagcgggtaggcgatcgacgccagaatcgcgaccaccgccagcgtcaccatcatttcaaccaaggtgatgccgcgcatccccgccggcccgctccgcccccgcttcacatgatctgccaccagccgctccaggaatagtattgctgcaacgggctgctgctggtgcagctcagcttgccgttggcgcaattattgttgctgttgccattgcccccgcccaccaggatgctggcgctgtagccgccctgattcgaggtgacgaaggccggcgtcgatgcgaagaagctgcccagctgcaccccggacaccggcaattggttatagacatcctggctattgaccaccccgttgccattggcgtcgaggaagggctgcgtcggcggcccgccggtggcgtagctcgacgccatcaggaacgacaggccgccgctggtgcaaggcgtggagggcggcgcgaaggtggtgtacaccacattgccggcgaagacctgcggattggtcagcacccgggtgccgctgccggcgaagctcagcgtgtagtaccagccgtacagggtcgggcaagtgcgccccaccacgcagctgagcggcgggttggggctttgccagttgtaggtggtcgaagtcaccgtggtgttggtgaagcccgactgcgccgaggtgaccagcgactcggtctgctgcaccaggttggacggcgtcaggccgctgatgctcagattgtcgtaaacggcgtagaaggcctgggtattggtattggtcagatcggattgggccagcagctggccggtgccgaaatagaccatcgtgcccttctgcttggggaagttggcgttcagcgtggccgcaggcgcggcggtgatcggctggtggttgccgctgctgtcggtggcggtgaacagcaggcgcacgctccaactggccggattgctgctgccgatgttgatcgcccagacattgccctgcagatcgccggcgtaaaccatgtccaccgccgcgccggcattgccgctgctgttgatcgccactacctcggacaagccttgcggcgcgctgctgttgcaggccgccggcaccgagctgcacagatctatcttggccagcgtggcgccggtctgcggattcaccgcatagaagatggcgtggttgccgctgctggcgtagccgttgccgaacatcaccgcgaatcccggcgtggcgttgacccgggcgatggagggccgaccataggtatagcccaggccgctgtcgctgaattcccacagcgcggcattggccagcgccgtctcgctggtgaaattggacggcgtggtcacgtccagcgcgtaaatggtggagcctccgccgcccaggccgccgaccagcagcgaatgccagacgccgttggcgaacatcacgtcgccggcctgcggcgagccgtcgacgaaatagatgtggttgttgttgtacgaggcgctggtcagctggtacaggttggaaaacacgccgttggggatgaaggcgaaagcctcgttgccggtgctggcgttgaatgcgtgcagcataccgtcgttgccgccgacatagagcagcggcgtgcggttggcgttggcgttgatgaagctcaggtagctggcgtcgctgtacgggccatccggtttggccacatacaccgggccgctgtctatgatgtcgcccagcaggtggctgcggttgcggaagccgccgccgttctgcacctcctgcgacttgtcgccgcgcaggtagttgagccgcaggctgcccttggtgtccgatggctgcagccagccctgctgggtgctgttgatgccggtgacgccggaagccggccattcgaacggcacgcccttgctgttgaccgcgtcccaggtggcgatcaagcgcgtgttttgccaggcgttgctgctggagaaggtgtccacctgagtctgcgcctgccagttggcgctggtgccgacgttcagcccgctgctggtggacaacgaataggccgacagattgccggtccagtcgttgtacgggctgtcgctgggattgaagctggcgaggaaagcctgcgaattggtgctcagcgtggtgctgttgagcgccaccgacgcctggtcgtaactgcctttctggatctgcaccaggatggagctgagcgcgttgctgaacgcggtggcgctgactgccgggtaataggagccggtattgcccgccaccgccatcgcggtcagcgtctgcgccgccgtaggattggtagccggcgccaccccggcgcccaggcctatcacatatgtcttgatgccgctgttggccagcgactggatctggctgatggtgtccagcaacgcctgatcgttggtggcgccggtgttgagcgagccgtcggcgttgaagctggcggtcacgccatagccgctggcggcggcgctgcccgccggcggccagaagttgccgctcttgtcctgggttggcaggccgtcggtgatcagcaccacgtatttttgcggcgagcagccgctgctggacgacgtgctggtgaacgaggtttgcgcggtcttcagcagcgcgtagatcggcgactgcccggccgccgacttgatttcgctggtgctggtggaattggtttccggctgcaggaacggcgagaagctgttgtaggcgctggtgagctggctggccgacgggctgcccagattggtcatcgtcacattggtggtggcgccggagtacgactgcgagccgccatagccccagccgcgctgcacatacatcacctgcggcgagtaaggcacgtagccggcattggtcggactggtggcccagttggtgcgcccgcccggtgccatcgtgctgtaggacaccgacaccgagccggacttgtagctgctcagcgagtaataggtgtagggattgctggggctgaccgtgccgtaggtcatgaacaccgggttgagcgacgaggaatacagcacgtcgttgatgttggcgtcgtcgctggtggccgccaccgtcatgtactggctgccgctgaccgacgacccgctgaggcccagcgacagcgcgatcgacgcgcaattgctggccacggtggtcgacgacgaggtcaggtagttgtagcaggggttgtagaccgtgtcggtgctgctggtggcggtgggcgtattggtgaaggcgaagccgccggtcggcgccatgtaatacacccaggtggtgtacatcctggtgttgctcatctggtaggacaacagggcgaaatccgtcgtcgccagataggtgttgaggatcgacaggatgccggccttggcgacattgagccgcgacgggctgttgtcggccagttggccgccggacagcgtcgaggtgtacggcaccaggctgccggccgcgccgcccgacaccggaggcgtgaagctggccggcaccgggtagttgatcggcgaggacgagccggtcagtccgctcaccgcgccggcgccggtcagcaaagcgccgccgcggccggtatagctggtggaaaagccattgctgcagttggcgccggaattgccggtgccgttgcaataagtgatggtgctgccgtccatcgattcggaattggtgacggcgatcaccacctgcggccgcgccggggtggtgatggtcagcggcacctgcgagatcgccagcgtggcggtggagccgccgccggccaccttccgggccgccagcagaatgcatgccagcagcaggatgccgaccacgatgcgcaccgccggtttccagtcagccatatccgcctcactgcgtgaagattgcctggaccaccaccgggctcgcgccgttgctggtgaccacccgggcggtcacccggtagttgttgccgccggccgcctgcccatagatcccgcggttgccgcagctggttcccgcccggcaggccgccggcatgttttccaccacatagctgctggtgacggccgaattgggcggcgtgccggtatagccgggaatcgtcatcgcgctattggtccagaacgaaggtgtgtataaattctgctgccacgccggcacggtgttggcgttgaactggtagtagccgttgttgcccgccaccgtgtaggtctggctggcgaacacgccctgcagcatggccgagtacgcctggcgcagcgtgccctccgccagctccagattgctctggtactgcacgttgttgctggccatgtgcagctggctcagcgattgggtgctgccggccagccccaggatcatgatcaccagcatgaagataagggcgatgatcaataccacgccgcgctccgagccggctttgcgcaatggtttcataggcccgcgttcctcaacgataccgtcatggtgtagacatggcgcagccgggtgtcgcaaggcacattgaccgtattgctcagcaccgtccactgcgtccggttgaggcaattgccggccttgctgagcggcgcggtgccttgcggcccttccagcagcaccgcgatgcgcaggctgttcacctggctccagctgctgatctggttggccggcaaatattcggtggtgacgcctggcgcgctgcctatgccgtaccacacctgcatggtgtccaccccgggcacgataggggtcacctgccagcctccgccggtgccgtcatacaccgcctggtacaacgcgctttgcgttcccgaggcctggccgacgaagtaagctgtctgcgacagcaacgccgccaccgagcccaccggaaaatcgctgtccagcgcctggttgagattgatgacgctgccgccgctggcgctgcccaccccgctgacctgcatgatggacgagtgcgcgcaattggagaccgacagcagattgttggccgccacgcccgatgccgacagcgtctgcaacgaagtcgcgccggtcgaggcgtaaacgctcacccacaccggcaccgtgccgttgctctggccgctgaagaccaccacgtcgctgccgggctgcaccttgccctgcaggctgctgtccagcgccgggctccagtcggtcagcgcgctgtcgttggcgccgttcaggctggacaaggtcagcgtggacgacgccaccaccgcgtcatagccggtgaccggcgcgctgaaattccccagcaggccattggcgctcaccagcgcgttggaagtagtcgccccggaacagccgaagaaaccggcgctgcgcgccgtctgcgaaatcaggctggaaacggtggcgccggcgttctgcagctggccctgaccggcgtcggtcgaataatccttgcgccccgccaccatcacacccaccagcgcggtcagcagcagcaggccgatggtgaccgccaccatcagctccaccagcgaaaaacctgtctgcgcgcgcgtcggcctcacatgatggtcctcacgatttcggtgagcaccgcaccgccgctcgccgcgttgccatccgtccaccacacctgcaccacccgctcggtggtggcgccgctggccggctgataaatgctgccagtgccgttcggcagattgttctgcaagtcggtcagccactggtatttgtcgaaagtggccatggtggcggcagtgcaggccgtggccacgcaattgctttgaaaagtggacgcgctgacgccggaggcgacgtcataggcgccggcggccacctgcgcggaattcgcccgcatccggtccaccatatcgtaggcatactgattcgccatctggcgcagatagccggagccgctggcgcgctccgcgttgagcatcaccgcgatggcggccaacacccccatggccagcaccagcagcgcgatcagcacttccagcatcgtgaagcccattgccgcccgccaacctctcattgcccggactcccgtctatggtcacaaggaaagccgctttgcctcattgcaagcataggagacgcgtcgctccagccgaaaaggcctgccgacggaagtaagcgccgtggcgacggacggtcgccgcgggggaacggggaggggacggcaaggccgaaacggcgccgccccacgggcggcggccgaaacgcagaaaccccagctcatcgagctggggttctgtatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtatttgacgtacgtcgcacatccactctcttgtgtctcagtttcccaagccactcaaatgataggatcaagcctcacgagcaattagtatcggttagcttcacgcctcacagcgcttccacacccgacctatcaacgtcctggtctcgaacgactcttcagggaggtcaagcctccagggaagtctcatcttcaggcaagtttcccgcttagatgctttcagcggttatctcttccgaacttagctacccggcgatgccactggcgtgacaaccggtacaccagaggttcgtccactccggtcctctcgtacgggctgctcctagtacgagaggaccggagtggacgaacctctggtgtaccggttgtcacgccagtggcatcgccgggtagctaagttcggaagagataaccgctgaaagcattttcccgcttagatgctttcagcggttatctcttccgaacttagctacccggcgatgccactggcgtgacaaccggtacaccagaggttcgtccactccggtcctctcgtacgggctgctcctagtacgagaggaccggagtggacgaacctctggtgtaccggttgtcacgccagtggcatcgccgggtagctaagttcggaagagataaccgctgaaagcatntggtctgtcccattccccgtggacactaacttaaggtggataatccccaccaaggagcagtgttcatgaccaagaccagacgtactttcccggaggccctcaagcgcgaagcggttgagcaggtgcttgccggcaccccgttacggcatgttgcccaagcctttgacattaccgagtcgctgctgggcaagtggaagcgtcaactccaagacgcaggacccgatgccttccctggccgaggcaaacagaccggtgaagccgccgagctcaagcgactgcgggatgaactggcccgcgttaccatggagcgcgatgtcctaaaaaaggcgctcgccatcttctcgcaacccacgaagtgaaattccgcgcgattcaggcgctgtcggaccgctacccggtagccccgatgtgccaactgtttcgtgtgtcccgcagtggctactatgcgtggctacaccgcccaccttcggcgcgagagatggcgaaccgacaactactacgtgaaatccggctggtgcatgccgaggtcaatggtatttatggccatcggcgtattcatgccgaacttcttgcacagggcttcgcctgcgggcggcatcgcatcgcgggcctgatgcggcgaaacggtatcagggttagaacgcgtaaacattgtcgacccgtcagtggtggtcaacaccttctacccgtggcgcctaatctgctgcagcgacaatttgctgctggtggcgacatcaatcagcgttgggtgtcggatatgacctatatccggaccggtgaagggtggctgtacttggcggtggtgctcgacttgtactcccgggcgatagtgggctgggccatgcatcatcgaatgccgcaagaactggtgcatgctgccctgacgatggcagtggcgcgccgccagccttcaggagaggtgattctgcattcggaccgcgggagtcagtactgtgcctttgactaccaggcattgctgaaacggcacggaatggtaccgagccactcccgcaccgggaactgctgggataatgcagcaatggagagcttcttccgttcattgaagtcggaacgtgtttatctgacccactaccggagctacgaggaggcgcgtacggatgtgtttgattacatccgcttttacaatcaccaacgacgtcattcaaccctggggtatctgaccccggttgaattcgaacgccgccgttcagagcttagtgcttaacccgctgtccatggggagtgggacagaccattacatcccactgcgttccatatcccatctacacacatgacagcctatcaagtagctctcggccctcagcttcctaacgcatgactcacaacagaccactgccgacacggcaacgcatcctaggcgccaccctccacccggttgcggccgccggccttggcctggtacagcgcctggtcggcgcgcttcaccaccgcttccggctgttcatcggcacggccggccaccgccagaccgatgctgacggtgatgcggccgacatccggcgcttgcgattgctcgaccacggcgcggatcttctccgccaacaccgccgcgccttcggcatcggtggccggcagcagcagcagaaattcctcgccgccgtagcgcgcgacgaaatcggtggcgcgggccgcctggcggatgacttgggcgagatgggccagcacgcggtcgccggcgtcgtggccgcagctatcgttgacgcgcttgaaatggtcgatgtccagcagcagcacggcatagggttcgccgctgcggccatagcgctggtgctcgtcctgcagctgctcgttggcggccatgcggttgttcaggccggtcagcgcatcgttgcgcgccagtttggccagctgtgtggccttggccaccagcagccggttggcctcgcgcaattcattggtgcggtctgccaccgcgccttccaggctggcattgatgtcggccagttgctgcttgcgggccagcagcgcggtggtcatttcacgcatggattccgacagctggcgcagctcttgcgcgccgccatggatttcccaatcggccccctcttccccgcggccgacgcgctcggcgatctccgccagttcctccagcggccggctgaacgaggtcgccagccggtacaccgccgccatcagcagcacgctggccgccagccccagcagcagcaataccccgcgcagctgattcaaggccgccagcgcctgctgccgcggctggcggacaatcacgcgccagcccaccccggcatgctgcgcccaggcttcgctgtacaggtagtcgccgccgtccggccaggcgcccaggcggaaggtttggccgacgggcagcggcgcgggcgcccgcgtccgccctatcgcctcgaacggcgacaggatgttgttctgtttatcgacgatgaaagcctccagcccgcccttggccggtagccgcgtccggatgatttcttccacccaatcccatagcgcgtgggtagccagcacgccgcgcagcttgcccgaggcgtcgtacagcggcgaagcgaagtcgacgaagcgcagcggctcgccctggagcttggccgacggcagcagcttggccagcagcaccgcctggtggatgtcgccgacgaaaggcgcgtgccggccctggatgaaccacggccgcttggccacgctttggcccagcagcatgccgccggtggaggacagcaccttgccctgagtgtcggcgacgccgatccaggcgtagtagcggtaggtttgcttggtgcgctccaggctttggcgcagctcgtcgccatccagcggcgcgctgacgtaggtgggcgtctgcgccagcagcatcacctcgcggtggcgttcgcgcagattgctttctatcgcctgggcgatgctgccggtcaggctgcccatcgcttcgccctggtcccgcagcatgcgctgggacagcacctgatccaggcacagccctgccaccagcgccgaggcgagaaacagccccccaaacaacgcggccagccgcaagcggaaactgccgggcaaggcgaaacgatgatggctcattgctacccttcgctcaggactaggacatggatgcactatcctaccccaaagcgcgccgcctctttcaatgcccggccgccccggttagccaccgcgttccgccagcagccggcgcgcccgcgcctgcccggccgtggaaatggccagcgccgccgccaccagcagcgcggccgccgcgaaagtggcgcgcatgccggcggccgccgcttccgccggcccggcgccggagtgggccgatgccgccgcgaataccgcgcccagcgccgccgcgccggtgatcaaacccagattgcgcgacaggctgagcatgccggccgccacgccgcggcgcgccgcgccggcgttcgccatcagcgccgtattgttggccgcctggaacagcgcgtagccggcggtggtcatccccatggggcagagatagccgaatatgcccaggctggacggcagcagcgccagcagaagcgtcccgcccagcatgcccagcaggccggcgcggctgacgcgcccgccgccgaaacgatcgaccaggcggcctgccggcacgccgcagcaggcagacaacagcgggccgaccgacaacgccagccccacccgcgccgcttccagccccagcgcgcgggacaggtaaaagggcccgaccaccagcgtggacatgatgaccgtggacaccagcgcgctcatggccagacccgcggccagctccggttggcgcagcatggccggctgcagcaacggcgatgccgcgcgcgcctccacccggatgaacaacgcggcgccggccgcggcggccagcagcaagccgccgcccagcgcgccgaagcggccttgcccctgcgtcatcgccagcgcgtaagccgccagcgtcaaggccaacaacagcgtgcccagcgggtcgaaatcctggcgtccgggtttggccgcccgccggtcggccggcaggtaacggcgcgccagcgcgaaattgaccaaacccagcggcacgttgaccaggaaaatggcgcgccatcccaggcccgcggtcaacaaaccgcccagcgacggccccagcgtggtgccgatggccgacatgctgcccaacagccccatcgcgctgcctgtccgcccctgcgccgccgcctccccagccatggcgatggccagcgccatcatcaccgccgcgcccagcccctgcgccgcgcgggcggcgatcaaggccggcagcgtcggcgccagcccgcacagcagcgacgccgcggtgaacagcgcgatgcccgccaacagcagacggcggcggcccagcaggtcgcccagccggccgacgctgacaatcagcgtggtcaccgccaacaaataggccagcacgatccattgcgcctgctggaaggtggcgtccagcgcctgcgccagcgccggcaggccggcgttggcgatgctggtatccagcgaaggcatcaacatggtcagcgccaggctggccactgcccaggcggccgacggcgccgcgccggcctcacgattatccgatttcaaagtccgctccttgccattgcgcgcggcccgccgcgcggggccgcatgccaagcaaggtaaaccctggccagagatggcggaaggcgcagcatttgcatttcattaatgcacacgacgccatatatgctaaggtccagccatgtccaaacccgatttgaacctgctgatcgccctggacgcgctgctggcggaaaacaatgtggcgcgcgcggccaagcgcttgcggctcagcccgtcggccatgagccgcaccctggcgcgcctgcgcgaaaccaccggcgaccccttgctggtgcgcgccggccgcagcctgacgcccactccgcgcgcgctggcattgcgcgagcaagtcggccggctggtggaagaagcggaagccgcgctgcgcccggcgcagacgttggatctggcgcagctggcccgcaccttcgtgctgcgcgccaacgaaggcttcgtggaaaacttcggcccggcgctgctggcgcgcgtcggcgcgcaggcgcccggcgtgcggctgcgcttcgcgcccaagccggacaaggacagcgggccgctgcgcgacggcagcgtcgacctggaaatcggcgtggtgggcaaagccaccggaccggaagtgcgcgcccgcgcgctgtttcgcgaccgtttcatcggcgtggtgcgcgatggccatccgttggcgcagggcgaaatcacgcccgcccgctatgcggccggccgacatgtgctggcatcccgccggggcctggagcgcgggccgatagacgacgcgctggccgcgctggagctggagcgggacatcgccgccaccgtggccggcttttccagcgcgctggcgctggcgcgcgaatccgacctgatcgccagcgtgccggagcgcggcaccggcaagctgcgcgccggcatgttcaacttcgcgctgccgctggccgcgccggaaatcaccgtttccatgctgtggcacccgcgcctggacgccgatttggcgcaccgctggctgcgcggctgcctgctggcggtgtgcgagccgccggctcaaaccggatgcacgccgccatccgggctagccgcctcgcgctgccgctgatggcgctgctggccgccgtcccggcgcgggcaatggactgcgccgccccccgcctcagcggggcggaaacatggatctgcgccacgccagcgctcttgatggcggacatgagcctcaacgacagctaccgcatcgcggcattgctagccccatcccggccggcgctgcgccgggaacaacaggcctggctgcgcgcgcgcgaacaatgccgcgaccagcgctgcctgcggcaaagttatgtcgaccgagcccggcagctgcgcgcccgcatccgcgactgggcccagccctgcgccgtcgacccgcgccgcatcctcggcgactgggaaagcatccgcagcggaaccttcgaccaattccagcttgcccccggccatcggttccacagctggctgcaccagcggccagaattcaacgacaagccatggaccttcgccgctagcgattgccgtctgagcatcggtgccggccgcgacgggatcgcattcgcgttcctgctggcccagccccggccggaccggctgatcctgatcgactccggcagcctggatgcccagctgtataaaaagctgcgctaggaaaccgcctgcgccgcccgccgccccgcgcgccaggcggaatagcccaggcacagcaaggacgccgcgctcagcaagtgcttgccgctggtcatcgcgccgcccgcccaggctatcggcgggtaaaaatccggataggaaaccagatcgatatagctgcacaggttttccagcgcgtcggcgcccgccaccatcagcggcagcaagttgaaccagccgggccgcggcagccgccggcgcagcaggctgatcaacaaggcgaagccggcgccgtagcacagcaggaacagcgtgtcgaaagccagaaaatgcagatagccctggcggccagccgcgccgtaagccgccagcagcgcccgcaccgcgtcggccgaataccagggccgcaagtccagaatgggctggccatacaggcgcgccagccggctgaccgacagcgcggtgtcggagaagttgaacagccaggccagcgcggccgccgccagcagcaaaaccagcgcggcgggcgccgaagagcggcggtacagccacaggctcaggccgcgcatgcgccgccctccgccgccacctcctggccgagctgccgcagcgattgggccagcgccgtgtccagcggcgtcggcgtccaatcgcccagccgcgcgcgcagcgcccggccatccagcgcatgcggacgccgccacaggtagcggttgccccacatcgaccgcagcatcggcgagaacggccgcatcagccccagccagccccagggcagcgcgcgcgcgcgcagcggccggcccaacacccgctgcaacgcctcctgcagctgccggccagtcaggtcgtggcccggcatcatcatccggttgaagccgcggatgccggcgcgctggtcggccagacgggcaaaggcctcggccaggtccgccagatgggtccaggcgtggacgctgtccagcgggccggggtaagtgaacacgccacgctgcaggccggcggcaatcaccttgtcgaaccatacgccggtgccctggccgaagaaatcgccggcggtgagcacgaagctgtccaggccgggcgccgtcgccagccgccgctccatttcgatgcggatggcgccgaacacatggcccggcgcggccggcgtgccttccgtcagcgtcgccggcaggctggagccgaagttgtagaccgtgcccggcaacaacagcagcgcgccggccgcctgcgccgcggcgatggcgttgtccagcataggcagcgcgtcgcgccgccagcaggcctgggtgtattgcgaaggattgagcgcgtgcgccaccacctggcaaccgcgcgcggcggcgaggatcgcggcgcggtcgtggccgtcgcaatggacttcctccacccggccctcgccgcgccagccggcgcgcgtttgcgcccttacctgccagccccgctcgcgcagcgcttgaaccatcgccatgccgaaacggccgttggcgcccaataccagtgctttccgggtatccatccgtctgctcctctctcatagggaagcctcattctctggcttccggccagggcgaggaagacgcataatgggatactggatatgcatttttgaatgactgaatcatggactggaatctggtgcaagccttcctggcggcggcggaagccggctcgctcagcgcggcggccgacaagacccggcaaagccagcccacgctgagccggcaagtggcggcgctggaagccgccatgggcgtgagcctgttcgaacgcagcccgcgcggcctgcggctgacgcaggcgggcgaagcgctgctggcgccggcccgcgccatgcgcgcggcggcggcggaggtggccaccgccgcggaacaaggccggcaattgctgccgggcacggtgcgcgtcgccgccagcgagatgaccgccgcctacctgctgcccgacatgctgagcgcgctgcggcgcgactacccgcagatcgccatcgacatcgtggtcaacaacggcctcgacaacctattggagcgggaggcggacatcgccatccgccatgccaggccggcgcagggcgcgctgatcgcccgccagctgggagagctgaaaatccaggcctgggcgcacgacagctacctggcgcggcacccgccgctcaaacggctgcaggactacgactggataggcatggaccgttccgatttcctgctgcggcggatgcgggaagccggtttcgacgtggatcgcgacttcttcgcgctgcgctgcgacaaccaggtggtaggctggcagctggcgctggccggcgccggcgtcgctttcgcgccggcggccaccgccagccgcttccccggcatgcggccggtgctgcccgagctggcgcaaggcatgatgccggtgtggctggcctgccaccgcgaactgcggcaaaacgcgcgcatacgctgcgtgttcgatcatctggccgccagctggcaaaacctgctggctagccagccgccagccgcgcttcgccactgagcgcgttccggcgcgccgccaggcacagtcccagcagcaggcaagcgatccccgcgccgaccaggcacacccccagccagccggcataggcgtaggccaggctggccgcgccggaacccagcgcgccgccgaggaaatagctgaccaggtaaaccgtggtgatgcggctgcgcgcctccggcgccagcgcgtagatcacgctctggttggagatgtgcagcgcctgcacgcatacatccagcaacagcaccccggccagcagcgccgccagccattggccgcccagccacaacaggccgaaggccaacagaatgcccaggcagcagcaacgcgtgaccagcccgccgcggccgcggtcggccaggcggccggcgccgctggccgccagcgtgcccgccgcccccaccaggccgaaggcgccgatctgcgcctcgctgtaagcgtacgacggctggctgagcagaaaggtcaggccggtccagaacaggctgaagcaggcgaaggccagcgcgccgtacagcgcgcgcagccgcagcgccggatgggcgcgcgccagcgtcagcagcgaggccagcagttcgcggtagcgcagcggcggcttgccgccgtcgcggggcagcgcccgcgccagaatcacggtgaacagcagcaccaccgcggcggccagccagtacaccagccgccagccgcccagctgggccaccaggccggcgaaggtgcgcgccagcagaatgcccagcagcagaccgctcatcaccgtgcccaccacccggccgcgctcgcgctccgccgccagcgaggcggcgaacggcaccaatagctgcgcggcgcaagtgcacaggcccagcgccacgcaggccgccgcgaaccaggcgaggcccgggctcagcgccaccgccagcaaggccagcgcgctgctgcccagcagcgtcacgatcagccggcgccggtcccacacatcgcccagcggcaccagcagcagcaagccgcaggcatagcccagctgggtgagagtgacgacgaagcccaggctggcggccggctggccgaagccatgggcgatgaccgccagcagcggctgcgaataatagatgttgccgatgacggcgccgcaggaaaccgcgaacagcagcgtcatggcgcggctcaagccggtggaaggggtatccatgtccatccttgggaaaaacggaaaaacaaaaacggccgcgtcggaaacgcggccgccggtgcccgaatcaatagggcttgttgggcaggaatttgccgtccagcgtgatcaccgcgcgctcgccgccttcgggatcggccactttctggatgtccagccggaagttgatggcgctgatgataccatcgcccagtttctcatggaccagcgccttcagcgtggtgccgtagatctggatcatttcgtaaaagcggtagatggtggggtcggtgggaatgccgcccgggatgctgccgcgcagcggaatggcctgcagattggcggaatccgccgcgtccaggcccagcttgtcgcacacccggtcggcggcggccttgggcagcgcgtgctgccccaacagggcggcggtgacataggccaagctgaggccggtgccggcggccagctgctcccagctcagatcctgcaaagccttggcggcgatgatgcgggcggtcagttcgacgcgggcgtcctgggtggtatgcgattgctgcatggtatttcctttcttgagtgaaacgcgcccggcgggcgcggagtgcgatggcgctcaggcggcgcgggtatgtggaaagtcgcccagcgggacaaagcgcttggcggcgccgtccagcgtttcgatgttgccggtgccgatgtcgtagacccagccgtgcaggcgcagccggccttgctccagcgccacggccaccgccgggtgggttttgaggttggccaattgggcgatgacgttttccctgaccatgtcgctcagcctggcttcggccgaggcgtgagttcgagcggcgttgaccgccttggccgcgtcggcgtggcgcagccagccggccaccgccggcatgtggtcgagacaggcgcagcgggaaatcgcggtcatcgcgccgcagtcggaatggccgcagatgacgatgtcgctgacgcccagcgcggccaccgcgtactccaccgtggcggtgacgccgcccggctcggggccgtagccgggcacgatgttgccggcgttgcggatcacgaacaggtcgcccggctcctgctgcgtcagcaattccggcaccacccggctgtcggagcaggtgacgaacagcacgctggggctctggctggaagccagctggcggaacagctcggaacgtttggggaaagcttcctgctgaaacttgaggaagccgtcgatgatggcttgcatggggggttctccttggcgggtgaaacgatggcgcaaggatgaaccgatcagactatagcgtccaagactgatatagaatcatatcaataagaaaaacctatagttcattcatgatactcagacacatccgctatctggtcgccgtggccgaacacggcaacttcacccgcgccgccgaggcgctgcacgtgtcgcagccgacgctgtcgcaacagatccgccaattggaagatcaggtgggcgcgccgctgctggaccgcagcggccgcgcggtgcggccgaccgatgccggcgcggcctacctggaatacgcgcggcgggcgctgcgcgagctggcggccgcccagcgcgccacccaagaggtggcggacctgtcgcgcggcgcgctccggctggcgatgacgcccacgtttacctgctatctgctgggaccgctggtggaacgctatgcggcgcggcaccccggcgtgaagctggaaatccgcgagatgacgcaggatgcgatggaggcggcgctggcagccgacgagctggatctgggcatcgccttcgataccgcaggcgcgccggaaatccagcgccagccgctattcgcggaaaagctgtgcgtggtggccggcccgcgccaccgctggcgcgagctagcgacgccgttggacgcgcgcgcactggaacaagcgccgctggcgctgctgagcgcggacttcgccacccgaggccatatcgacgcgcacttccgccagctgggcatcgcgccgcgcgtagccatggaggccaataccataggcgccatcctggaaacggtgcgccgcggcgccatggccaccatcctgccggaggccatcgcccggcaagacccggccttgcatgcgctggaaatgcggccggcgctgccagcgcgcaccgccgccctgctctgccggcgggacggctaccgcagcgccgccgcccgcgcctgcctgccgctgctggaagagctggcgggacaactggcctaaacgaagccgtaaaaaaaccgcatggcgctcacatgcggttttctctcgaaggccggcctcactcggccagcgcctcctccagcgcggccgtgtcctcatagaagtgatacaaaacgattttgccgtccctcaccttgccgatcagcgcccaatcgctggcgaagggtttgccggtggccacgctgtaatgccgcagccggccgtgcatcgccgcgtgctcgccgtcgccgaaagccgactccacttcaaattcgccaggcttcaattcggcggcgaaagattgaaacacctgggccgcgccggcctgcccccggtaagtgccgtacagggacaccttggcgctggcctgcggccggctgggaatgaaaaccgcgtcatccgccaccaaggccaacgcttccgccatccggccgctgaatacgtggtcgaggaaagtctgcacgatctgaatgctgctcatactggctcctgaaagttggaaaaaccggacaaggtcaatttgcctatggcgtcgccccgctccagccgggcatgggcgtcgccgagcgcgcgggcggaaagctggcccaggtgctcgcgccgggtactgcgtatccgcccggcctccgccaaagcggtcaaccgggccaggatgtccccctgccgcgccatgtcggcagtctggaacatggagcgggtgaacatgtagttccagctgaagctggcgctcttgcgcatcagcgcgttgagttcgaccggccgggaaaacggcacgacattggcgatatggccgaacggcgcgatcagttcggccaaggcggcgaagtgctcatccgggcgattgagcagcaaaacggattgcacggccgggatgccgatggcctccagttgcggccgcaaaggcagactatggtcgatcacctcatgcgcgcccatctggcggcaccaggccgtggactccgcgcgcgaggcggtggccaccacccgcaagccgggcaccagccgcgccagctggatggcgatggagccgacgccgccggcgccgcccaccaccagcaaggttcgcccatcggccggcgcgtccggcgcataacccaggtgctcgaacagcgcctcccaggcagtcagcccggtcaaaggcagggcggcggcctccaccgcgctccagttggcgggacggcgcgccgccaggcgcgcgtccaccagctggtaggcgctattgcagccgggccggttcacatcgccggcatagtatatcgagtcgccgggctggaaccacgccgccgcctcagccccgcaggccgccaccacaccggcggcgtcccagccgagcaccgccgcctggcgccatcatccgccttgcgccggcgcacgcggcaatcggccggattcaccgccacggcgtccacccggaccaacacatcccagccagcaggcgtgggcaccggcaggatcaaatcgcgcagttcggccggcggcgcggccaggatgccgaccgcgggcatctgcgggggaagtctgtccatatcggccgctcgcgtgaaatgaagatgccgtcagtgtagcgccttgatttattcggcataagtcgaataaattggccacatctgtgcatttatgatcggactgccatgcaatgggacgatgtgcgttattttctggcgctggcgcgcgaaggcagcctgtcggccggggcgcgggccttgggggtggagcacagcacgatatcgcgtcgggtgggccagctggaagccgcgctggggctgcggctgtttgatcgcctgccgcgcggctggcagttgacccagaagggagaaagcctgctgccgcaggccttggcgctggaaaccggcatcgccgggatgctgcgctcggcctcggcgaagaacgcgctggccggccaagtgcggctgaccgcgccgccgcagttgctcaaccatgtgctgctgccgctgttgacgacgttccgccagcgttacccggatatcgatctgactttgctaggcgagcggcgccgcgcccggctggaacaaggcgaagccgacctggcgctgcggctggacgtgcccgacacgccggagctgatcgcccggccgctggccctggtgggctacgcgctgtatggcaccgcgcgctggcggcaaaccgaggcaagcgaatggctgttcatcggcttcgacgacagccaggccggcttgtccctgaagcgatggctgggagaacacgccggcgcgcgccgggtggcgctgcgcggcaacgatctggatacccatttccaggcggcgagacagggcctgggcgtagcgctgctgccgcgcttcctggcgcgcgccgcgccggagctcgccgaactggacagcccgccgccgccggacaagcagctttacctgctgatgcatccggacgtgcgccgcgcgccgcgggtgcgcgcgctggcggacttcatcgccgcggcgctgccgggcgcgctggcttgagccgaatcagccccagctgccccagaacagccacagcacgatggggccgcccaggatcagccacttcagcagatagtaggtgaaacggctctgcgccttgatcctcttgccgaacaggcgcacctgctgaatgtagcggaaggcgcggttgagcgcgccgacgcggtcgccggcttcgttcggcgcattggccgcgcccaccagcacgcggctgacgatgcggttgatcactcgcgccggccagaaccacatcggccgctccacgtcgcagaacagaatgatgcggttctggtcggtggtgttttccgcgtagtgcagataggtctcgtcgaaaatcaccgcctcgccgtcgcgccagctgtattgctggccgtccacgtcgatgtagcagcggtcgtcgttgggcgtgatcagccccaggtggtagcgcaccgaaccggcgaacggatcgcggtggcgcaccaggcggctgcccggcggcagcgcggtgaacatcgccgccttgatattgggaaactgcttcaaaagctcggtggtgtacgggcacagcgcctgcgcggacgggtggtcctggccgtaccatttcaggtagaagcgcttccagccggtcttgaagaaggaattgaagcccagatcgtcgtacttgtccgaggccttgatgttgccgcggtcgtacaacgccaccgcctcttcgcggatcttctcccagttggcggtcagcgcctgcagctcggggaagcgctccaccggcagatacggtttgggcggcaccttggaaaacagatacatgaagcagttgatcggggccatgatggtggagtggtcgctcaactggcgccaaaaaccaagccgtacgcggccgcggaaatgaacgtagacggtggagaggatgaagatcgccaccaccagaatcttgatataaggcatcgggactcctgcggaactaaaaacggcatgactgccgcagccaatcattttaaacgatgcggcgcgaggcgtagtagccgacactgaaattaataacaaaggccagtaccggcgccgcgcggcaaacgcccggcataggatccgcgccgccgcagcgcggccagcccctctcgccgcccctgcgtcatgccgcacaccgacaaacaacttatatgacatggcagtatcgccggcgctgccatataatggcgcacaggcgctgcgagcggttcgcgccgccaacaacagactgaacagcgcattcacccgatccaccccgacagacacgcgaaaccctcgaacggcagcatgctgcacggacagcaccggcggaaccctaatgccttttcaaaccttgcgccatttcaaaaattggattgtcggcatcttcaatccgccctaccagctctcgctgtgcgaaatcctgccgggccggcaaggcggcggcaccgtctacgttttcaagcaatacggcacccacgacatcgtcaagctgagccataaggacatcatcggcaatgtccagattctggccgccattaatcccaaggatttgatcggcatcgcgctgtacgaaaacaacctgaaggaagccgccggcgaatgccaggtgctggagaccatccgcggcaatcaataccggatcgccagccacggccgcgaagaggtgtattccggagaaagcatctgcggcaacctggacctgttccaacgcctgccgccgcacgaaatttgcaagatcgcctacgaaaccggcttcagcaagggccgcaaggtgtccggccaactgcgcgcgctggccgagcagggccgcgccgaagccggcgcggccgcggccaatgtggtgccgctgcgctcacgccaatgaagtggccacccgatagccgtccgcggagaagctgaacaagcggtagccctggcggtcgtcgatatcgatgtcgctggcccccgcctgccactggaaacaagtggccgggccaacctccagcatgcggccgcggtaatcgatactgtgagcgccatgcacatggccgcagatcaccagcttcagccgctcggcccgcgccgcctgccagaactgcgaactctggcgcagcatgcagtcgtccagcaatggcgtcccgaccgccagcggatggtggtgcagcactacggcggcgtggccatcgtccaccgcggccagctgctcgcgcaaacgcgccagttcgtcggcgccgatcagcccttcgtccagccccgccacgcagctgtccacgccgatgaaggtccagccggccagcttcacctcatccagcggccgcaacagcggatagccggcgaacacctcggccatcgtcgagcggcagtcgtgattgccggcgatccaatacaccggccgtccgagcccggccagcgcctcggccgccagccggtacgacgccgcggactcatcctgcgacacatcgccggtgagaaacaccgcgtcgaccgcgtccggccccagcgcccgcaccgcggccaataccttttgcagcgccgcgtaggtatcgcggcccagcaaccggccgtcgcgcgcggcgaacaaatgcagatcggtcagttgcaggatattcatgccttggcgctctcaaaacggttgcgttcaatggcgccgtcgctatcgcggaacaccgtcagcggattgtaggaaacttcccaatcgaaataatcggtgcgctctatcttcttgatcaccgacaccagatagtagcccagcggcagcagcaacaccgacatcaccaccttgtacgaccaggtggtggcgatgatgttgaccagctcatggccgctgtacttggaagacaggctgataggataggcggtgagcagcagcacagcctgcgccagcatcgaggcgatcaggtaacgggcgaagaagaagcggccggcaaaaaatatcttcatccgcgaaacgatgaagccattgcagaaataggaagccggcaccgaaatccaggtgcccaccatcacgcgccagaattcgtggaataactggtaatactgcttggagatggcgttgttgtccggctggatcagcgcgaaagcgttgagaatcaacacgaacagggtctggcaaatcacgatgatccaaaccgtgcggccgcccagcttgtagccgtacacctcggtggaaatggtggacaacaaatagcacagcgaaaacacgatgccgctggcggtgattttcaggctgaagacatctacggttttgtacaccagcgaatcacagataatcatgatggtgacagtcaaaccaactatcaatccatacaagcgaaactcgttcaacgcacgcctccagacaaggttttgatggctttcaacaccacggccagcacctgatagtttttataaagcgacggcgccacatcgttctgtggcgatatcgacgaaaacagcaaaaaatcctcttcgacatacacccggcgcagacagggagagttggcgcctatcgtcaccagcacgatatcgccatcctgcggccggctctcccgcaccatcacgaaaaccgtgccctgcgcgtaatgcgggtacagcgtgtcgttattgaccaataccgcgaatagcggccgctcggcatagccgacaacctccgcgcaataatctccttggtcggcgataccggtttcgatgaaatcgccgacatggccgatgccgaccaagggcatggaaaaaaccgcctgccgcggcagcgccgactgcttggcgccggatgccgccaattcgccgatgctgacctggaaatagcgcgccaactcgaccagcgtggacaaggtgggattgccgacgcctcgccgcaaattgttgatggtggcaatgcccaggccggtctcatcgctcagccgcacagcatccacgccatgcctttgcatcaggctggccaaattgccggagatcaccgccaacgggtcatcattcgccggcagcgccttttccactcccttcaccattcgctcatcccaaagcgttgacagaaaccgccacccctcccgcgaacccttgccgcgacgcgatggcgcggccgatcaggccgccaaatataaagcggcgaaactctcattgcaaatacaaatccgccagcataaagtactaagagagataaaaaattcttaattaattcaaacaagaaagaaactaataaaaactatttcggcacggcgcgcctgtttactgcctaagaaaaaatgataatataatatcaagcgggacaataaaatgtttgtcgcgcgatttccataattgcagtcgaaattttttatcccaaacgttgtcgccactccgaggttgcttcgccatgcacaacccaaacctgactgaatgcattcatgaagatgaattcgcggtagacgtcatcaatggagaaaaggtcctgatcaccctgcccaccatgctgggtcagcaaggcagcgaatgggagggctcgcccatcttcggcaggagctacctgatgtcgctgatccggcgcggcatagaaaacgacgtgctgcacccggcggatatccagcgcgcgctgagtcgcgaagccagcctgcgcgcctgctcgatggaatgaccgggaaaccccggcatgaaaaagccccggcgcgatcgctctgcgccggggcttgtcttcaactgggccgttgattagaacagctggtccttgacgttttccaccgcgtcctgggccgccggcttgtcgtcggcggccggcgcgctggcgtcgtcgccgctgcccggcaccgtgccctggttgtcgatgtgcagctccggattggtcttctggaactcttggtagtagtactcgtcgccgccgcgctgaccggcgcccggcttcaccacgatgccctgcggcaccggcagctcgacttcaggctggcccttcagcgcgttgcccatgtagttgatccagatcggcaaggccgcggagccgccatagccgtaacggcccagcgagcgcggctggtcgaagcctacccaggtggcggccaccaggttggggttgaagccgacgaaccaggcgtctttccagtccgaggtggtgccggtcttgccggccaggtcggtgcggcccaggctcatcgcgcggtagccggtgccgtaacgcaccacgtcccccatcatcgaacgcatgatgaaggcgttgcgcggatcaatcgcctgctgggcgttctggccggccaccgtgggcacggtcttggccagcacgcggccggactggtcttcaatgcggtcgatgaagtaagccttggtgcgatagccgccgttggcgaacaccgaatagccctccaccatctgcagcggcgtcaccgagcccgcgcccagcgccatcggcaagtaggccggatgctgcttggcggagaagccgaagcgctggatgtattgctgcgcgtaatcggtgcccacggccatcagcacccgcaccgacaccaggtttttcgactgggtcaggccgcggcgcagggtgatcaggccggagaacttgccgtcatcgttcttgggctcccagttctggccgttgatgccgggcaccgacagcggcgcgtcgttgatcatggtggaaggcgtgatgccgcgctcgatgccggacgaatagatgaacggcttgaacgacgagccgggctggcgccaagcctgggtcacgtgattgaagctgcggcggttgaaatcaaagccgcccaccagcgatttgatcgcgccggtatgggtatccagcgacacgaaagcgccttccacttccggcatctgcaccacttcccaatagcccttggcattggccgacacgcggatcaccgagccgcggcggatctgcagctgctgcgacgccttgccgctcagcgcgcggcgggcgaattcaaggccagcgcccttgatggagatggtcttgccgccgcgcatataggcctggatttccgacgggctggccgacagcacgatggccggcagcatgtcgccgctgtcgcgcaaatcacccatcgcctcgtccagcgcctcggtcaggtcctcgccaccgccgctgggcaggtcgatggtgctttccgggccgcgatagcccatcttgcggtcgtaatcaaccaggccggcgcgcaaggcgtcataggcccatttctggtggcggctgtccagcgtggtgtaaaccttgaagccctcggtgtaagccgcttccttgtaacgctcgtacatcgcctggcgtaccatttccgcaacatactggcccggctggctggtatcggcagcctggctggccagtttcagcggctcgttcagcgcctcgtcgtactgcgcctgggtgatgaagttgagctcgcgcatgcggcgcagcacgtattgctggcgcagcttggcgcgctcggggttgacgatggggttgtaggccgacggcgccttcggcaggcccgccagcatcgccatctgggcgacgctgagctcgttgatcggcttgccgtaataggcctgcgccgccgccgcgaagccgtaggcgcgctgccccaggtagatctggttgaagtacagctcgaggatctggtccttgctcagcgtgtgctcgatcttgaacgccagcagcgcctcgttgaacttgcgggtgaaggttttctcgctggacaggaagaagttcttcgccacctgcatggtgatggtgctggcgccggagcgggcgtggccggacaccagattgccgaccgccgcgcgcatgattcccaggtagtcgatgccgctgtgctggtagaaacgctcgtcctcggcggccagcacggcctgcttcatcagctgcgggacttcgtggatgcgggaaaaggatcgccgctcctcgccgaactcgcccagcagctgattatcggccgaatacacccggagcgggattttcggacggtaatcggtgattacatcaaggctttgcaggcgcggataagttatgatgatggcaattgcggcggctcccgccagcagcaccacaccacctagaaacacgcctgccattattgcaagaaatcgtctgagcatatttacgatgggctttcactggaaacaggattataacgtcttgtgaaagccaacaagacaaacaatggcggcgacagtgcgaaaatctgttgcacaagaccggattgaggcgcagatgctagtcgataaattgaggctcgggcatccattgctcgaacaactgggactggggcaatcccgcaacgcttccctgcttggcctggacatcagcagcacggcggtcaagctggtggagctgtcgcgcaacggcaagaattaccaggtggagcgctacgtgatcgagccgctgcccaaggaggcggtcaacgacggcaacctggtggaaattgacggcatcgccgaggcgctgcgccgcgcctggaaacgtctgggcagcccgatccgcagcgtcgccatcgccattcccactccgatggccatttacaagaagctgctggtgccggtcagccagaccgaagagctggaccagatgatagagtccgaagccaaccagatcatccccttccccctcgacgaagtgaacctggaccaccaggtgctgggcccctccccgtccagcatcgacgacctcgaggtcctgctgtgcgcggcgcgtaaggaaaaggtcgaggagcgcgtggcggtggtggaaatggccggcctgcgcgccctggtggtggacgtggagtcattcgcgatgatgacggcgttcgagcagatccagcaccagctgcccgaccagggcatgaatcagactttcgccatgttcgacatcggcgccacccgcatccactgcaacatcatccgcaacggccagcagatctactaccgcgagcagatgttcggcggccaccagctgacgcgcgacatccagcgccgctacaacatcagcttcgaggaggcggaaagcggcaagcgcagcatggcgatgcccgacggctacgaatcggagctgatgcacccgttcatcgattcgctggcacaggaaatccagcgcgcgctgcagtttttctacaccaccgtcagcgtgtcgcaatacctgcgcgtcgactacatcctgctggccggcggctgcagcatgctgcccggcctggacgacgcggtggccggccgcacccagatcagcaccatgatcgccaaccccttcaccaccatggtgcaatcgagcgccatccgcctgaaagagctgctgatggatgcgccggcgctgctgatcgcctgcgggctggccctcaggaggttcgactgaatgatacggatcaacctcctcccccaccgcgagcagcgcaaggccgcgcaccggctgcgcttccagctgctgctggccggcaccgccgtatcggcgctgctgctggtgggcatcgcctacctggtgcttgagcaccagctgtcgcgccaggagcagcgcaaccgctacctgcaggcggaaatcggccggctggacggccagatcaaggacatcggcaagctgaagaagcagcgcgacgacctgctggcgcgaaaacagctggtggagcggctgcaggagggccgcaacgaggcggtgcacctgttcgaccagctggtgcgccagacgcccgacggcgtctacctgcgcagcttccgccagaacggcaaccagatcgtgctgaccggcttcgcgcagtccggcgcgcgggtgtccagctacatgcgcatgctcgggcaatcggaaaccttcgaggcgccggtgctggtcgaggtgtcgtcgtccatcgtcaacaaccagcgcgtcagcgccttcaccctcaacgccagcctgcgccaggcgcccgcgggcggtccgcaaggagccaagccatgacgctggacgaactgcgcggactcgaccccaaggacatggccaactggccgctgcaggcgcaggcgctgatgctggcgatcctgacgctgctggtggccgggctgggctatttcttcgtgctgggcgatcagctagaccatttgaaccaggcccgcctgcaagaggcccagctcaagcagaccttcgtcgacaagaagcgccaggcggtgaacctggacgcgctgcagcagcagttgcgcgagatcgacgcctccttcggcgcgctgctcaagcaactgcccaccaaatcggacatggacaccctgctgaccgagatcaaccaggccggactgggacgcggcctgcagttcgagctgttcaagcccggcagcgaatcgcgctccgccgaaatggccgaggtgccgatcagcatccgcctgtccggcagctacaacgacctcgccgccttcgtcaacgacgtcgcccagctgtcgcgcatcgtcaccatcagcgacatttccctcaacccgggcggcggcaaggacaaccgcctgacgatggacgccaccgcgcgcacctaccgcgcgctggagcccagcgagcgcagcggcctgcccgccgcccagccaaagtgagggacgcgccaagatgaagaaaacctgcgtctgcctgctgcccctgctgctgagcggatgcggcggccccggcaccgaggacctgcagcagtggatggccagcagcagccagggcctgcgcggccagatcgagccgctgccgcaggtgcagacctacaagccgttcaactaccaggcctacgatctgctcgacccgttcaacgcgcaaaaactacaggccggcaaacagcaaaactccgccaacgcgcccgacctcaagcgcccgcgcgaggcgctggaaaattacgatctggacaagctggcgatggtcggcacgctgaagcgcggcgactcgctctacgcgctggtgcgcacgccggagggcgccatctaccgaatccagcccggcaactacgtcggtcccaatttcggcaaggtgaccgccatccacgattcggaaatcgtgctctccgaaaccgtcgaagacctgaatggagaatgggtgcagcgcgacagcagcctgcacctggacgaacaagggcaaaacaaatgaaaaagcttgcgatcagatggatggcggggctgctgctgagcctggcgggcggactcgccgccgccggcccggccatcacggcgatagaacccggcaaggtggacggcaacctgcagctcgtgcagatcaccttcgacggccccgcggtgcggccgggcagcttcgccatgtccaacccgccgcgcatcgcgctggacttcgccggcgccagcgtcaagctcgcccgccccgccatcaatatcgacagcgcgctgctcaagtcggcggtcgcggtggaggcgcccggccgctcgcggctggtattgagcctggcgcgcaacgcctccttccgcagcgtggtcaacggcaacaaattgctgctgacgctggacggctcgatggcgccggcgctggatgccaccccgcaagagcaaacctcggcggcagccccccaggccgcgggccaggcgcagatcggccaggccggcctggacttccgccgcggcgccaatggcgaaggccgggtggagctggccctgcccaacgccaacaccccggtggatgtgcgccgcgacggcaaaaacctggcggtcgacatcgccggcgcggtcctgccgcgccagcaggtgcgccggctggacgtgaccgacttcggcaccccggtggccaaggtggatgccgccaaccagggaaacaacatccgcatccagatcatcccccagggcgactgggactattcctcctatcagaccgacggcaagctggtggtggaagtgcgccgcccggcgccggaaacgctggccaacagcgacggcggcaagccggtgtacaagggcgacaagctgtcgctcaacttccagaacatcgaagtccgcaccgtgctgcaagtcatcgcggaattcaccggcctcaacatcgtcaccagcgactcggtcagcggcaacatcaccctcaggctgaaggacgtaccctgggatcaggcgctggacctgatcctgcagaccaagggcctggatcagcgccgcaacggcaacatcatccagatcgcgccgcgcgacgagctgctggcgcgcgacaagcagctgcaggaagcccgccagcagctggcgacgctggagccgctgcgttcggaaaccttcgtgctgcgctaccgttcggccgaagacttcaagaaagtgctggatggcgacaacacctccggcaagaaagaaagcctgctgtccgaacgcggcagcgtgctgatcgatcccaagaccaacaccctgatcgtcaacgacatcaacgcggtgatcgacaagatccgcgacgtcatcgccaagaccgacatcccggtcaagcaagtgctgatcgaggcccgcatcgtcgaagccaccgacaactgggaacgcgacctcggcatccagctcacctacgaccggatggaccccaagggcatcatttcgggcagcccgctgggcaccgcggtcaacaacgtcaccaacctgaacaccggccagccctacgtgatccagaccacgccggccggcgtcaacctgcccatcgccaatccctccggcacgctgaccgcgctgtacaacgtcggccactcggtgatcctggggctggagctgcaggcaatgcaggccgaggacaagggccgcatcatctccagcccgcgggtgatgaccgccgaccgccaggaagcgaccatcgagcagggcaccgagattccctatcaggaagccagctccagcggcgcgacctcggtatcgttcaagaaagcggtgctcagcctcaacgtcaagccgcagatcaccccggacaatcacgtgatgctggacatcaaggtcaacaaggactcggccaacttccagcaaaccgtcaacggcacgccgtcgctgaccaccgagaaaatcgaaacccaagtgctggtggacaacggcggcacggtggtgctgggcggcatctatcagcagcaactggacaatgtcgtcaacaaagtgcctttcctcggcgacataccgcttctgggcgcgctgttccgcagctcgcagaagatagacaagcgcagcgaattgctgattttcatcacgcccaaggtggtcaacgacctgatcgtcgcgggacgctgacgggcagagacagagccgcgatccatcggctacaatggctgccatggagagattggcaggcaacttttttctggtcggcctgatgggcgcgggcaagaccacggtaggcagggcgctggcgcgccgcaccggcaagacgttctacgattccgaccaggaaatcgaggcgcgcaccggcgtgcgggtcgctaccatcttcgacatcgaaggcgagctgcggtttcgcaaccgcgaaacctgcgtgatccgcgacctggcccagcagagcgacattgtgctggccaccggcggcggcgcggtcctgcgccaggaaaaccgccaggtgctgatgcaatacggcaccgtgatctacctgcgcgcgccgatcgacgacctgctggcccgcacccagcacgacaagaaccgtccgctgctgcaaatcgccgacccccgcgccaaactggaaagcctgttcaacgagcgcgaccctctctaccgggaaatcgccgacgtcatcgtcgacaccacccagcaaaacgtcaacctgctggtcagccgcctgatcgaccagttgcagccccccatcaccaaggaagccgattcgtgatcaccctcgacctgatcctccccgacacccgctacccgatacatattggccacggactcctggaacaggtcgaactattgcttccccacctgcccatccccaaggtggccatcgtcagcaacgaaaccgtcgcgccgctgtacttggcgcggctgcggcaagcgcttgaaagccgcggcgtggcctgcgccagcatcgtcctgcccgacggcgaaacgcacaaggactggcagacgctcaacctgatcttcgacgccctgctgtccggcaacgccgaacgcaagaccacgctgatcgcgctgggcggcggcgtgatcggcgacatgacgggcttcgccgccgcctgctaccagcgcggcgcgcccttcatccagattcccaccacgctgctggcgcaggtggactcgtcggtcggcggcaaaaccgcgatcaaccatccgcagggcaagaacatgataggcgcgttctaccagcccaaggcggtgatcgccgacatggacctgctcgccaccctgcccgaccgcgaactgtccgccggcctggcggaagtgatcaaatacggcctgctgggcgacgccgacttccttgcctggctggaagacaatatggccaggctgagggcgcgcgacagcgccgcgctgcaatacgcggtgcgccgcagctgcgagatgaaggccgccatcgtcaccgaagacgaaaaagaaaacggcgcgcgcgcgctgctcaatctgggacacaccttcggccacgcgatagaagccgggctgggattcggcgcctggctgcacggcgaagccgtcgccgccggcatggtgctggccgccgccgcctccgccgagctgggctggcttgccgccgccgacctcgatcgggtgcgccggctgatcgccgccgccggcctgccggtgacatctcccgccatgcccgtccaccgctggctgcagctgatgagccacgacaagaaagtggaagccggcaccatacgcttcgtgctgctgcgcgcattgggccaggccgtgatccaacctggcctggcggacagcctgctggagaagattctgcgcgaaaacagctgagtccacggctgagcggcccaggtagggatttatacggattgccaagccgccttcctcgtcagaataatcaacagactacataagatgttgtaccaccgagggggagaaacagaatggatgtatttacggccttggccagcagcttggccctgatgcttgtctattattcgcttcgccagttctggcgtcgcctgcgctacaccaagccggtccaccgcggcatcgatccggttggcgaggccgaagtctatctcgcctacggccgcaccaaagaggcggtccgggtgctgaaagactccctcaaagacgatccggacaatctccacgccaaagtggcattgctgcgcgcctattccagcgcccgcaacagcgaagcctatgtgttgctggcgcgcgatgtgcaggcgcaggtgcaagaccagccggtctggcacaccatccaggagaacggccgccagctcgcgccacaggatccgttgttcgacgccaagttgtaaaccggccagtcatgtaactgatgcgcgccccagtcggcgcgcaactcgagcttatacaagcaaaaccggctaccaacgcggcacggcacgttgcccaactcagcaccatcctggcgcacaatgccccgcgtaagcccactcgcagacggaggggcgcttcatgccattcgcagcaccatccacacccctcgcaaacgcaaaaaaaccactcaaggagtggtttctttaaccggatatccggctatggttacgctgatacctgactagccttgccatactgcaatttatataaggtggacagcaaaaccgcctgtaccgtggcatatacagaagcgtacataaccaagccgagcgtgatatgggtgtaaccgacaatgaaaaagataacattgcaaaccagcccaatcttgccgatcttcacaagctcgggctcgcctgaaaccgccgccttccaataaggatagctgccccctacatagaaaatgacatacgccagcaaaccgaccgagcccagactggccgcattgaagaacaactcgccatgagtatcagccgcatccgcaaccggaagaccaacaaagccctgctcatatagtgcatgcatcaccggtggtaaatcccggccgacgccaaaaatcggatgcatcttgaatatatgccatgaagccagtgccatatccatacgcatgcttaccgagccatctttttttccaacaaaaaaggcatggtattccgataccgccaagtctatgcggtatttgacgattgcactgcagaagtaagacagcacgagaagcgcgaacacaagcaacaaaataccggcaaaactcttccagttaaaaccaaacacggttgtaaacaggaatagcgctgcaacgacacccgcagcccaaaccccgcgcgactccgaaaaatacagaaccaagtatgtagttgcaatcacgacaatcgaggcaacccgattccagccaccaagactatatgaatagaggaagaaaatcgtgccaaacaacaagcagaatgcagaatacggaatagtattcgtaaatgctgtcgcaatgcgcagatcaccgccatgggtcatattccaatagccgaatatcagcatcaagaacacggcagcggcaaaaatccaccgtgccgatttcagatcgaatctggcgctatggcacatcgctacgaataacggaatagccagcatggttctggaggctgaatccgcgaaacgaaatcgaggatcgccggaaatcagctctctacaaataatcgccaagccaagaatagacatggcgaaaatccagggcctatacaaatcccagcatatcttgaaatagtttttcctgaaagaaagggctatgccaatcaaggaaagcaagcaagccactatcgtagcgctacccctccagacaaaacccaatgcgatgacaataaatgtcaatccccaaacaagccaatcataacgtaagtcgcgctgacgctctattgccatatcaatcatctcaccgccctctttaaaaggaaaaatggccgtaaagcccatggtgccaacgaatagaagaacatcctgattttaaagctcaaagcgactcctggtgcatctaccaaatatttaaacctgcccatccaacctgcttgctttcttaacataaactcaatcagacactctttttgatagagattcaccagatacgtcagcagtgccggcgtggcatgcttattcccagcgacttctatcatatgcaacaactcgattttggtattatccagctttttaacaaatgccgagacaacagcttcaacagtcaagtgtcgcttcttatatgtcgtgcccccccgcctatacaacaccaacggttcaggaattgtcacagccccaccggccccaaacgccctaaaagccatgaccatgtcctcagccaccacgcctcgcggtatgccggaaaattcatcatatagccgccgcgtccatgcctgagctgctccgatcaaaaccggatgcccctgaagccaagcatccacgctattatagttcgcaaggtcgtcaaccttgatcaccccatgcacattaccagccgaatccaaatcctgcagataagaagccagcaagtcgggctttcggccatgcgcaagccaacaagccactaatgatgagactcgttgcggcaacgaaatgtcatcgccagcggtaacgacaaatagctcgcctgaagcatgagataccgcaacattcagattagcgccgattccgacgttggatatattgcaattcaaaatcagcttatgcggcccctggtagttatcgcaatacgccgatacaatatcaaaagttgaatcactcgaacaatcgtccgaaacaacaatttccagattggcataatcctgagaaagcgcgccttttagcgcatctaaaacataatgctcttgattataggtaatcaggagcatggaaacttttggcagtgattccatcagttactccaacaatgccagcaaatccagcacatgatcttccaatgaataaggataatgaatagactgggatgccaaggaggccgggtctctttccaagtgcttagcctgcctgaccactcgctccaggcatgtcctcaatgccgccgcatcccgtttgaagacatgacagcctggctcggacaatatttccgtcgcacctaccgtatcggcaaataaaacgggggtgccgcacaaaattgattctgggcccaccatgccaaatgcttcatattttgaggccaggatcgtcgcatccgccgccgcatacaacgggggcatttcatcgcagaaccctgcgttgataaccttatcgcttttcagcggcgcttttcccgccgctaccaacacaacatcttcatccatgcgaccaatcgcatccaggatgatgtctgcgcccttcaaatcatgattatttgatggaaacaagagcatgaactggtttggtctgataccaagcttctgtctaacctcttcgcgattggccctggcatccaatgaaaacttgtgggtgtctacgggaggatataagacttttattttggcctcatcaataccataatatttctggatttccttccccactctcccagaatgagaaacgatagtcgatgcgccagcataaaacctggtctcattcgcgatggtcaatctgtcataaataccaacactggatttacccttgtcattcaggtgaccgatatgcgtaccacccacaatcgccaagtcgacatcaccgaacacccttgatatgccaatggttttccagccagttcgacaagacctcagagccatacgttcaaacaatatgttatttagcctggagaacggtgttctatttgggaaaaccacgaaatcaaggccattcgggggatcgggccaattcacaactcgcgcgatgacctttaccggaatacccctgcggcacaactccgctatcacatccatcacatagcgttccattccaccgccctggcgaatggagtgaaagataaaattgatgccagaaatatcactcattccgattttccattcgacagccaaccaggatcaatatccaatgaggaaatacctttcaaggccttgacatgctcgctgcggattgacgcctcgaatcttctccagttttcaccctcaaaacttctatcattttccttatgccagagatgcagaaccggcatggcgaaacggccattcttgatgcccactccattgcgaatcaagcgaacagcgaagtccgaatcctcatagccccagccggaaaatgtggcatcaaatccatctaccatcaaataatcttcgcgccaaacaccgatattgcaaccacgcagcaatttccaactatcttttcttttcttgcgccactttggcaaatcaagccgcaaccaacccaaaaaattgttgatatttttcctcagccgatgagcaagccaggaaaatcccgtccaattggataccggacggcattcaccggaaacatagctcagggtaaatctttcggacatcaataccctattgccggcgaccacccagccgcgttcggcaagcttggcgtgctgaaacaggaagtccgactgtgggatgcaatccccgtccaggaatatcagataatcaccccgcgcctgcagcgccgcccggttccgaatctccgccaatcggaatcccaagtcctcatgccaaacatgctggagccgatcatggaaaatcttctgatgggccttcaccaccgcttgggttgcaggaccggagccatcgtcggcaacaatgatttcccaatcaccggcaagcatgcccgattggtggtgaaaaccagacaatactgcatcaagcgcatcaggccgattataggtactgatcaaaactgttattttcattcatcaaaccagccatatgaattcagacagcagatgccttggaaacctgccgtagccgaaatagccttgtggcgaacacggacacatcagacctttccgctccttctcagctccaaagcatgggcatacttcagataagaaccgatgcctttgcacatcgacaaggtcaagccatccaaaccggccagaaatcccagcttgatcacatagtggcggaaaaaagcccagccgccatgcagcgccggatgccagggatagattttcttgccgcttttagccaggcccactgaaagccattcggcatacttgcattttgcgatcatgtccggataattccggtacgaataatgcgtaatatgaaccgctaccttcgtcgaagtcgccgccttgacacaagtatgcgcgacaaccggcgtgaaatcggcccggtggcgattgaacaacctcttcacataatcggggtattgaccggcataaggcgtgaagcggtcgccaatataattgcggcgacgcgtttcgaccagatccacgcccagggcgtccagatcggtattcttcacataagcgatgaaatccggctccaacctttcatcggcatccagattcagtacccaggcatgccggcaacgcggcaagcccaggcttcgctgaggaccatcgcccaaaaaaggtttctgtacaatgacggtcgcgccttcggcctcagccagcgcaatggtgccatcggtgctacctgaatcgacaacaacgatgtcatcacaaaccgctctcaacgaccgcaggcaatcgacaatattgtgcgcttcattaagcgttatcaccaaaccactgatagccatccgcattctttcatctcagctgccaaattgcagcagatatagctttgaataaattccctgtttgtccagcaggtcctggtgtttgccgatctcggcgatctcgccctggtgcatcactacgatgcggtcggcactttctatcgtggacagacggtgagcaatgacgatcgtcgtccggtttttcatcagattatccagcgccgactgcaccagccgctccgacgcggtatccaacgcgctggttgcctcatccagaatcagaattggcgcatccttcagaatggcccgcgcgatcgccagccgttgtcgctggccgccggacaggcgagtgccgttttcgccgatcagggtatcaagcccctgcggcatcgcctcgatgaagtccagcgcgttggctgcgcgcgccgcttcgcggatcccgtcgcgcgtgacatcgcccaaacgcccgtaagcgatgttcgcggcgacggtgtcgttgaacaacaccacatcctggctgaccagggcgatctgctcgcgcaggctgactaggctgatctgcgtcagcggcacatcgtccagcagtatctggccggcagtcggctcgtagaagcggggaatcaggctggccaacgtggttttcccacctccgctggagccaaccagcgcgatggtttcgccagcgcggatgtctaggttgatatcacgcaatgccggtcgctccgcgcctggatactggaatgacagctgcttgaaccggaaatttcctttggtcgaacccaaacggatccggccctcatccggctccgcacgctcgtccaggaatttgaacacgctttccgcggcggctaaccccttctgcaccgtctgactaatgctggtgatgcgcttgatcggcgcgaacagcatcagcatcgcggtcaggaaggacatgaaatcgccggcggaaaaactgccatgctgcgccagcgtgccagcgaaatacaggatcaccgccagcgcgcaggcgatgatcagctgggtgacgccggtgctggcagcgctggtagcccgctccttgaccatattgtggcggatagactccgccgagcggctgaagcgctcgctctcgtagtcctggccgccgtaaaccttgaccacgcgctggcagtctatgctctcgcccagaatctgggtcatttcggccatatcctgctggtttttgcgcgacagaccgcgcaggcgcttgctgacgtagcggacacaccaagccacgatcggcatcaccgccaggcagatcagcgtgaggcgccagtcggttatcagcagcaaggccagcaggccaatcaccgtgatgccgtctttgatcaccacggtgatcacattgaaaccggcctcgctgatctgcgtcacgtcgaacaccacccgcgagacgatgctgcccgactggttgttgtcgtagtaattgaccggcagccgcaccatgcgggcgaacatttcctgcctcagcgtctgcaccagatggccggacagccagctggaagtatattcgttgatgtagctggtcaggccgcgcagcatgaacaggccgacgatggccagcggcgtccagacgatggcgtgtggatcgcggttgacgaagccgccgtcgatcagcggcttcatcagccgggcgaacatcggctcggtagccgccgcgatggtcatggtcagcatcgacaggatgaagaccttccagtagggccgcaggtacagcatcacccgcttgtagagcgcgaaactggttttgttatctaagaatgacatggacgaattctatcgaaactgcaggttgtgattccaatcgccaatccggctcgctcgctgatctgatggcatatcgccgcagcgtaacaaccggagttcaggcaaacatgtgccggcaggtttttttgttagcaagcgtgactcgggcgggtttcggccaacagcgactcgacctcggccagcacctgggccaccgcgatccgctcgatgcattcgctgcgctcgccgccgccacaaccggccagattgcagggtcgacagggcaggtccagcgaaacctggcgatgcggcacccgccatgggccccacactttgtcccgcgatgggccaaacaagaccaccaccggcgtttgcaccgccgcggcaaggtgcatgggcagggagtcgacgccgatgaacaatcgcgcctgcgcgatcagcgccgccaattgcttcaacgacagctgtccgctcaaatccaccaccggccgccgcacccctgcccgaacctcgcggatcatggcgttttcctccgccgacggcgcgccgctcaacacgacctgccactcttgctcatgcaaagcgttgatcaggccggccaccttgtccgccggccagcatttgtagaaccagcgcgaccccgggtgaaccaggatgaaacggcccgccgcgacgccattggcttgcagcaaggcgctcacgctttgctcggcttcggcgccgggcaccaccgaaagggcggtttccgcttccttgggataaattcccagccgtcgcagcgcgtcgagatgccattcgacgatatggcgcttgttacccagcaccagaccatggcggtgggtgaaagttttccggaaaaagcgcccgcgatcggggacgtccggcaccaccgaccagcgcggcttcagcagcctcaccaacgaggtagcgcgattattgtcgttgagcaccacgatcaactggtagccccgcgccttcaggctcgaatacagcgccagctcatggcgcagccgcgcccaggcgcccagcttcttccagccgcggtctatggtgaagacattggagatggccgggtgcagggtcagcatttcccgggtttcatggtagaccagcgcgtcaatctcgatgtgaggcgcatggtttttcagcacggtgaacaccggcgaggtcagcagcacgtcgccgtggtgcatcaacctgatcaccagcgcccgcctgacctgggatagatcgatcgcgtcttttagcataaataaaaaccgggcttaatcgcccggctctgcattcagcagttgcagtagatcggctattttatcagggtcttccgatctgagcatgcgcgtcgtgatcgaggcgatctcgtccaggtgggtggtcagcacctgttgcttcaccgacagcagattggccggatgcatcgagaacttgcgcaagcccatccccagcagcaggcgggtgagcttggcgtcgccggccatctcgccgcacaccgacaccggcacattggccttgatgccgcacttgatggtgtgcaggatcagcttcagcaccgccgggtggatcgggtcgtacaggtggctgacggtgtcgtcgttgcggtctatcgccagcgtgtactggatcaggtcgttggtgcccaccgacaggaagtcgaccagcttggtgaagctgccggccaccagcgccgccgacgggatttctatcatcgcgcccacttcgatgtcttcggcgtagcctatgccctcgtcgcgcagctccgacttcgcgtattcgaactgcgccagcgcctgccgcaattccggcagcgaattcaccatcgggaacagcacgcgtatccggccataggccgaggcgcgcagcagcgcgcgcagctgggcgcggaacatcaagggctccgccaggcacagccggatgccggtcaggccgagcgccgggttgtcggcctggtcgtggcccagccatttcgggctcttgtcagcgcccaagtccatggtgcggatggtcaccggcatgcccttcagcgccaccgccacgtggcggtaggcctcgaactgctcgtcctcggtcggcagcgtgtcgcgacccagaaacaggaactcgctgcggaacaaccccacccccaccgcgccggattcgcgcacgtcatcgacgtcctgcggccgctcgatattggccaacagctcgatcaccgagccgtcgcgagtgaccgcgctggacttgcggatcgacgacagcttgcgccgcgcgccgcgccaggcccgctgccggcgccggtattcgttcagcaccagcgtgtccggattgatgatcaccacgccctgcaggccgtcgacgatgatcatctcgtcctcgcggatcagctcgcggccgtggtgcagcgcgatcaccgacggcagatccaggctgcggcccaggatggcggtgtgcgaggtggcgccgccgacgtcggtgatgaaggcggcgaagttggaatccttgaaatacaccatgtcggccggcgacaggtcgtgcgccaccaggatgtggtcgtcgaccaggtcttcctgcgccggcaattgcggcgcgtcgccgtccaggttcttgaaaatgcgctcgaccacctgcagcacgtcgttcttgcgctcgcgcaggtagtcttcctcgatggcgtcgaattgctcgatcaggtggtcgcactgcagcttcagcgcccattcggcgttgcagtgctgcttttcgatgatttcgcgcggctcgcgcgagatggtgacgtcgcccagcagcatgatgtgcagcgacagaaaagcgccgagctccgccggcgcgttttccgggatgctgccccacagcatctccagctccttgcgcgtggcgcgcacggcttcgtcgaaacgcgccttttccgccggaatctcgccctcttccagcaaatagtgcgcaacatcgtccatgctgcgcgaaatcagatgggcccggccgatggcgatgccgccgccgatggccaccccgtgcaggatgatgctcattgtcccctcccctggcgggccgatgttattgtcgctgtgcccgccccattcccgccgccgacggcggcgggctccctgaacggccggggaaagccggccacccgctcagcgccgcgtcactccgcttcgtcaaagcggttgttgatcagcgcgatcagcgcctccagcgcctgctgctcgtcctcgccgctgatctccaattccaccttcgcgcccttggccgcggccagcatcatcacgcccatgatgctcttgccgttgacgcggcggttgttgcgggcgatgaagatatcgctcttgtaacggctggccagctgggtgaatttgctggacgcgcgcgcgtgcaagcccagcttgttgatgatttcgacttcagatcgcagcatttccttcccccgggataatgtaaagcacgccttccagcccgccggtgatcgccttgctgacgacgatctccagcggctggctgctgtagcacagcgctcgcaccagcatcggcagactggcgccggccaccgcctcgacccggcctgggcggatcagcctgctggcgatattggatggcgtgccgccgtacatatcggtcagcaccatcacgccgtcgccctgatccagcccgtccaccaggccctgcgcttctgccagcttgcgttccgggtcttcggtcttgtccaccaccatcaccgccagattgtccggttcccggcccaggatgtgcttggcgcaatcggccaggctacgccccaggtctccatgtgcaattatcagaacacctaccatgcctgagtcttcgaattggtgcggcccggcgcctgccggccgcgttatttgagcaaagctcgaaccgcgcgggcccgaatccgcccgcgcatccgcagatcaatcttcctgaattgtaacagctgaattctcgctgcggcggtaccaggccagcttgtccgccaattccaccacttcgccgacgatgatcagcgccggcgaggcgatgccgtgcgaggccatcagaccaggcagcgtcgataaagtgccgcacaccgtgcgctggcgcgcggtggtggcccactccaccgccgccgccggcgtcgccgccgcgcggccgttggcgatgaaggcctggcatagctcggccgccgtcgacacccccatgtacaccaccaccgtctgctgcggccgcgtcaacgccggccagtccagcgcgatgctgccgtcctgcttgtggccggtgacgaaggtgaccgactgcgcgtagtcgcggtgggtcagcggaatgcccgcataggccgccgcgccgctggccgaggtgatgccgggcaccacctcgaaggccacgccgttttccgccagcgtggcgatttcctcgccgccgcggccgaaggtgaacgggtcgccgcctttcagccgcagcacccgcttgccctgccgggccaggtccaccatcagctggttgatgtcgtcctgcggcagcgcgtggttggcgcgcgccttgccgacatagacgcgctcggcgtcacgccgcaccagctgcagcagctccggcgccaccagcttgtcgtacagcaccacgtcggcctgctgcatcagccgcagcgcgcggaaggtcagcaggtcgggattgcccggcccggcgcccaccaggtaaaccgcgccgacggtttccggccccgcgccggccaggcgccgctccatttccgccgccgcctgctcctcgtgtccgttcagcaccgcgtcggccagcggcccttccagcgcgtcctcccagaaacggcggcgctggtccacatcgggaaagcgctgcttgctgcgctcgcgaaaaccggcggcgaagcgggccagccggccgtaagcgccgggaatcaggctttccagccgcgcccgcatcatccgcaccagcaccggcacgccgccgccgctggcgatggctatcatcagcggcgagcggtcgacgatggccggcgtgatgtagcgcgaggcctcggcgtcgtccaccacgttgaccagcactcccagcgcctcggcatcgcgcgcgacgcggcggttcagttcgtcgtcctcgctggcggcgacgaccaggcgctggccgcgcagctgctccgccgcgtaggcgccggccaggtgggtcagctcgccgcggccggccatttcggccagctccggcgccaatgccggcgccgccacctgcagccgcgcgccggccgccgccagcagccgcgccttgcgcagggcggcctcgccgccgcccaccaccagacagggctgctgttgcaacttgaggaaaatcgggaagaaatccattcagcactccgcgccgcgcggccgtccggcggccgcggcagccatttcgcttgccagggcggaaccctccgccttttcgtcatcaagcatactgtatttgttgcataaatacgacgcttggccgcggcggcgcagagtcctggacggaacaccggctgctgatgtcaaaattcccgctttggtttgccgcctttcgcctggagcgctgtttgacccgccgaccctccgccttgcccatcctcccctgtctgctcccgctcctcgcccaaccggcctgggccgcggccggccatggcgcgtcgatgagccaggccggctggctgctggccatgctggtcaccgcgctctggctgcggggccgccagcaacggcgcaaagcccgcgccacgctgcaggacgcctgcctggggctcttggagttcgatctggcgcgccaatacgtgcgcggcagcgtccatacgctgcaacggctgctgggcctgccggcgcacacccgcggcatggactgcgcgcgctggctgactctgctgcaccccgaagaccgcccgcgcttcggcgaactgctgcggcagccgccgcagatgccggaagccggctacgaattgcgcatccgccattacagcggccactgggaatggctggaaatgagcctgcagccgacctggcgcgccggcaaggtcagcgcgctgaccgccatctgccgcgtcatcaccgcgcgcaagcacagcgaggcggcgatgatgcgccgcgagcagcagttccgcaccctggtggaaaactcggaagacatcatcgcccgctacgatctggagctgcactgcctgttcatcaaccgcagcgtgtcgcgcttctccgacctgccgctggaagaacacctgggcaagaccccgcgcgagaaaggctggaccgacgaggccagcacccgcttcgaaatggaatgccgccagctgatcaacaactgggaagcgcgcagcttcgagctggagctgtacaaggaccagcagcgccatatcttcgaaatccggctgttcccggaattcgacagcgccggcatgctgaagaccatcctgtcggtggaccgcgaagtcaccgccagccgccagggcgagcggctgctggcggaggaaaacgcggtgctggaaatgatagccggcaaccatccgctgccgcagacgctcaaccagatctgccagatgatggaatcgcagcagccgcgcggcctgtgcagcatcatgctgctggacgaggacggcgccgcgctgcgcttcgccgccggcctcagcctgccgccggcctaccgcaaggaggtggagcgcgtcgccgtcggccccagcgccggttcctgcggcaccgccgcgcactggaagcgcaccatcgttgtggacgacatccaggaaagcccgctgtgggcgcacgcgcggcacaaagcgcagcccttcggcctgcgcgcctgctgggccacgcccatcttctccagcgaccgccgcctgctgggcaccttcgccacctattaccgcgaaccgcgcagcccgacgccggaagagctggccctggcccaccgcagcacccacatcatcgccatcgcgctgcagcgccacggccacgagaagcagctgttccgcctggccacccaggacagcctgaccgagctgagcaaccgccgccagttcatcgagctggccgaccgcgaagtcgagcgcagccgccgcaaccacggcccgctgacggtgctgatgatggatctggaccatttcaaggacatcaacgacctgcacggccacgcgctgggcgacgacgtgatccgccacttcgcccaactgtgccgcgaagtcctgcgcgccagcgatttgtgcggccggctgggcggcgaggaattcgccgcggtgctgcccgacacccggctggaagacgccttgctggtggcggaacggctgcgcgccgcggtcgccgcgtcccggctgccgaccgacgacggcgagctcggctacaccgtcagcatcggcgcggcgatgcggctgccggccgaatcggacatcgacgaagtgctcagccgcgccgacaagctgctgtaccaggccaagcgagccggccgcaaccgcatttgcgccgacctggacgcgccggcggcgaatgcgccgctttccggctagaatggcggcctttcccaccgaacgccccgccgtgaaccactggcacgccgcctacctgtcccatccgctgtacgcgccgctgcggccgctgctcgccggcctgacgcctagcgactggcccgagcagcctgactacgaccgcctgctggcggccgcccgcgccgccggccgcccgctgccgccggcgctgcgcttcgtctgcggcctggagccggatggctattacgaaagccatatcgcggccaccggcgaagtgccgacccggcggcaaaactggcacgactggttcaacgcgctggcctggctcgcctggccgcaggccaagtcggcgctgaaccgccgccacgcgcgcgctctctcgcgcggcgaaacccggcgcgggccgctgcgcgacgccgccaccctgctcgacgaatgcggcgtgatcgtggcgacagccgacccggagctgggccgggcgctggacgacatgcgctggcggcggctgttcatcgagcggcgcgccgactggggccgtagcatagccgcccacacgctgggccacgcggtgatggagatggggttgacgccgcacataggctggtgcggcaaggcgctgattctggaggtggcgccggacttcttcgcgcgcgacgacgcggcgcggcagcggctgctcgatgcggcgctggcggcgcggctggacgacgacgccttcctcgccagcccccgcgcgctgtgcccgctgccgctgctgggcattccgggctggtggccggacaaccaagacccggccttctacgacaataccggctacttctgcccgacgcggcgggcgaagtccgccaccgtctcggcctgaagcccgccggtcagcggcgccagcagctcggccagcgccgtgcccagggcatcgccgcgcccaaggtcgcggcggtagacgaacagttcgaacaactccgacaacgggatcgccgccgcgcgcttcatcagcacccaggcgtcgccctgtcccttttgcacgtaaccgcgccgcgccagcttgtccagcaccaggcccagctcgtcgtaacccaccttcaccgcctgccgcagctgcggcggcgtcatcgcctcgccgcgcgcatgggcggcatccaacagcaacagcaccgccagcgcgtccaggaaacggcgctgcggctgattgcggcggcgccaggcatcgccctcccagtaggacagcgccgaggtgaacaccgcgccggccagcaccaccagccacaggcaatacacccacagcaggaagatcgggatgctggcgaaggcgccgtacaccagctggtagctggcgatctggccgatgtagaagccgaagccggccttggtggcctccagcagcaccgaagtggccagcgcgccccagatcgcgtgcttgatcggcacgaagcggttgggcacgatgcggtacagcagcgacagcaccagcgcggtcagcacgatggtgccgcccgcctccaccaggctggccagcaagggcaggtttttctcgaagcgggtgacgcggaacagccagcgccacgacagcaggctgccgcccagcaccagcggccccagcgtcagcaccgtccaatacaccatgccctgctgcagccacggccggccgcggcgcacgccccagatcgcgttgaaagtgcgctcgatggtggacatcagcatcagcgcggtgacgcccagcatcacgatgccggcggcagtgagcttttccgcgttgtcggcgaactggcgcatgtagacggtgatcaccttgccggcgaactccggcaccagcgtcgacagcagcatgatcttgaagcgggtgctgtagtcggaaaacaccggaaacgccgaaatcaccgtcagcgcgatggtgaacagcggcaccagcgccagcagcgtggtgaaggtcaggctgcccgacacctgcagcacgcgcaggccgcccatgcggcgcgcgaggaagcgggcaaagccgaaatagggttcgaatcgttggacttgcatggccgcaaaggtaatggcaaagcgccgatgaggcaagccggcgcgctttgccctatcatgcggcgattattgatgaatgcgaggtttttcatgctagacatcctggtgctgtattacagccagcacggcgccacccgcgagctggcccggctgatcgcgcgcggcgtcgacagcgtgcccggctgccaggcgcggctgcgcacggtgcccaaggtttccaccgtgtgcgaggccagcgagccggccatcccggaaaacggcgcgccctacgtggaaaagcaggatctgatcgactgcgccggcctggcgctgggcagccccacccgcttcggcaatatggcggcggcgatgaaatacttcctcgacggcaccagcggcgaatggatgcagggcgcgctgtccggcaagccggcctgcgtgttcaccagttcggcgtcgatgcacggcggccaggaatccaccttgttgaccatgatgatcccgctgctgcatcacggcatggtcatcgccggcctgccctattccgaaacggcgctggcggcgacgcaaaccggcggcacgccgtatggcgtcagccatgtatccggcctggacaaccgccaggcgatcagcgagcacgaaaaggcgctagcgctggcgcaagggaagcggctggcggagttggcggtgaagttggcggcaaattgaggtgcgagtaagaagcagccgatctaaacaaactgaaaatgaagtgtgctcacttcttgcccgttttcgtcttggcattaacgagtgctgaagccgctaatcctttagttaatttgcttgttgctttgcttctcaacgccttcgatgcggctgaagcgacggcttttgaagtccgaacagagtttttcttaccactcatagcttggctccttacataccaaccactacaaaatgtgcaaaaaattaacccaacacactagatatagtaacaaaaaggcctaactgcaaatattctctcttcgggaggatgagaccgctccgcggacaatgtttgggtgccggttccgtccggcaaacgggccaggggctgtacggccagccctgtcgctgagcgaatcgaagattcgcacgcagaggcgatcccaggccgcccccgcagcccgcgaagccccgacaaacagacactgggcaaggagccgccgaaactacatgcgtgcgaatctttgactcgtccagcagtacgcgctcccgtcgcgcggcgtcgaacaaatcggcggcttaaaaccttgcccagcgcctttttgccggcgcgcgccaaagggagaaggggcacgtcgctcacgctctaccccttgtagggcggaagccgcaacggggcgttccgccatctttccttcgctgagacttgtccaaacgattagggccgaaccgacgcgcccctcccccatcagagcaaaccgtctccaaagccactcccaaggttttaagacgccctttgtttgagcggggcgacgctagcgcccagcgagttgggcggcgccttgggaatggcttgggagacgggatttcgcagcgctgctggggcggcctgggattgaaaaggagctggccgcgctgcccccccccttttccgtccgccaggcggaaccggcactcaaatttcatccgcgaagcggacaccaaccggtgcgtcgcccctgcggggtgacgcaccctacgacaccgccaagaaactgctaggcggcgcgcccaattcccgcttgaacatggtggcaaaggcgcttgggctggcgtagcccaggtccagcgccaccttcagcacgctgtcgccgcaggccagccgctgcagcgccagcatcagccgcgcctggcgccgccactggccgaagctgaggccggtttcgcggcggaagcggcgctgcagggtgcgcgggtccagcgccagctcgcgcgcccactcggccgcgccgcgcgcgtcgtccggttgcgccagccagccatcgcacagctggcgcagcgcggccgatgacggctgcggcagcgacaagggcagcaccttggcgcgggcgatttcctccagcagcaggtccatcaccttttcatcgcgcgagccggcggcgcacggcaccgccaccgccatcgccgctaccaccagctcgcgcagcagcggcgtcacttccagcacgcagcaagcctcgggcaggccttgcagcttgtcctcgcgcacgtagatgctgcgcatccgcacatcgctgaccatcttgacctgatgccaggcgccgatcggcagccagatggcgcgcgtcggcggcaccacccactggccgcgctcggcgctgaccagcatcagcccctccaccgcgcacagcagctgggcggtgggatggttgtggcgcggcgtttccagccccgccggatagtcgcgcggcttgccgcgcaccggttccagcccgcgatcgaactggttcagatggtcgaagctgtccatgacgcctctttcgacaagatgaatgccctattttcgcaggaccgacgaaaacgcgcttgttaggatgaagccatcccacccgtaccgagtatcgatttcatgaccgcaagcacccagctagccgcgccggcgcaggacacgcgctttcgcgtgctcggcgccatcagcttttcccattttctcaacgacatgctgcagtcgctgctggtggcgctgtacccgttgctgaaaggcaactaccacctcagcttcgccgaaatcggcctgctgaccttcacctaccagtgcaccgcctcgctgctgcagccgctggtcggcatctataccgacaagaagccgcagccctactcgctggtgttcggcatgggctcgacgctgatcggcctgctcttgctgtccagcgccggcagcttcccgctgctgctgctggccgccgcgctgatcggcaccggctcgtccatcttccaccccgaatcgtcgcgggtggcgcggatggcttccggcggccgccccggcctcgcccagtccatcttccaggtcggcggcaacgccggcagcgccaccggcccgctcttggcggcgctgatcgtgctgccgctgggccagggcagcgtcgcctggttcagcctggccgcgctgctggcgatgtacgtgctgttccgcgtcggccagtggtacgcccatcagcaccgccaggcgaagaagggcgccgccgccgccaagccggcgctgccgcccggccgcgtcaagctgaccctgctgctgctgttgctgctggtgttctccaaacacttctacctggccagcatcaccagctactacaccttctatctgatccaccatttccatatcggcgtgcaatcggcgcagctgcacctgttcctgtttctgttcgccgtggccgccggcacggtgctgggcggcccgatcggcgacgccatcggccgcaagcgggtgatcggcttctccatcctcggcatcgcgccgctggcgctgctgctgccgcacgccgacctgttctggacctcggtgctgtcgtttccgatcggcttcatcctggcctcggccttcccggccatcctgatctacgcgcaggagctgctgccgggcaaggtgggcatggtgtcgggcatgttcttcggcttcgccttcggcatcggcggcatcggcgccgcggtgctgggcgaactggccgacctgaatggcatcgagttcgtctaccagctgtgcgccttcctgccgctgctgggcctagcgtcgctggcgctgcccgacctgcaccgccaggccaaggcctgacgcggcgcttgatccagcgcaaactccgacggcgcgccgccgccggagtttgcaaacgataatagctagcattatcatgtttttctgcatccggctccgccatggggccaacccgataaggaaaacataatgcgtcgcttcgtctgccagctggccatcgccagcgtagccctgtccgcctccttcgccgccatggccaaggaatacccgatcggcaaacccacgctgaaaaacggcatggaaatcggcgcggtctacctgcagcccaccaagatggacccggacggcatgatgctgaagccggaagcttccgacatccatctggaagccgacatccacgccaccaagaacaaccccaacggcttcgaagaaggcgcctggatgccctacctggtggtcaagtacgaactgaccaaggtcggcggcaagacccagaagggcgacctgatgccgatggtggccaacgacggcccgcactacggcgacaacgtcaagctgcaaggtccgggcaagtacaagctgaaatacaccgtgatgccgccgtcggccaacgagcacgcccacttcggccgccacgtcgacaaggaaaccggcgtcgccccgtggttcaagccgtttgaaatcaactacgagttcaccttcgccggcatcggcaagaagggcggctactgattcgcgcggcggtaatgtgaacgcaaagcattattgattgcgatacaatgaaacggcgcggcccgaagagccgcgccgtttcacattccgggatgaggattcgatgactgttctgcgcctgttggccgccgccctgctggccggcctgttctccgcttcggcattggccgaggaaatgccggtgttcaagctggaaatcaaggatggctatttcaagcccgcccggctggtggtgcccgccggcaagaaattcaaggtggaagtgatgaataccggcaagacgccggccgagttcgaaagcacgccgctgcgcaaggaaaaggtgctgggccccggcgcggaatccttcctggtgttccagccgctgtcgcccggcgaatacaagtttttcgacgagttccacatgaagaccggccagggcgtgatcgtcgccaaataatctcgcgggaatcgatatgggacaggtacttttcattgtctggcgcgaaagcgtcgaggccttgctggtggtcggcattctcaatgcctggatgaaccagaacgaagccggccgcgccggcaagccctatctgtggggcggcgtggcgctgggcgtcgcgctggccatcgcgctggcggtggcgctgttcgcggccagcagcctgatggcgggcgcgcaggattacttccagctcggcatggtgttcatcgccgccgccctgatcgtgcagatggtgctatggatgcgcgagcacggccgcacgctgaagaaagaactggaaagcgggctgagcgaaaacgcccgcagcgacaactggtggggggtcaccgtgctggccgcgctggccatcgcccgcgaaggcagcgaggccgtggtgttcctgtacggcatgctggccgaagcccagggcatggagctggccaagatgggcgtggccggcctggtaggcctgctgctggccttcctcactttctacctgctgcagctgggcggcaaggtgctgtcgtggcggctgttcttccgcgtcaccgaaatcatgctgctgctgctgggcgcctcgctgttcctcaacggcgtggagaaactgatctcgatggacatcctgccgccgctggtggacccgctgtgggacagctcggcgctgcttgacgacatgagcccgttcggcggcgtggtggcttcgctcaccggctaccgctcgcacccggcgctgaccagcctgatcgcctacgcgctgttctggctggcgatctggagcctgttccagtggcgcaaccgccgccaggccgccgccgcatgaaagcggatcccaagcggctgcgcccgcagcgggtgattcccatcgtcgccgccccgggcggcggctcctgtagcccgcagcgacagccgcgcggcctgctggcgctggcgggcatctggctgcgcgaccacgccgcgctgctgcgcaagctgcaatgggcggtggtgctggtttacgccttcctgctgattgtccccgcctgcctgccgctgccggaagacaccgcgcggatgtgggacaacctgaccatcttcgcccagttcgtgttctggggcatctggtggccgttcgtgctgctgtcgatggtgctgttcggccggctgtggtgcggcgtgctgtgcccggagggcgcgctgtcggaatgggcggcgcgcaagggcatgggacggccgattccgcgctggatgcgctggggcggctggcctttcgtcgccttcgtcctcaccaccgtctacggccagctggtcagcgtctaccaatacccgaaagccgcgctcttggtgctgggcggctccaccgtggccgccgtcgccgtcggtttcgtctacacccgcggcaagcgcgcctggtgccgccatctgtgcccggtcaacggcgtgttcggcctgttgtccaagctggcgccgctgtactaccgcgtcgacgaggccgcctggaaagcctcgcatgagcggacgccggcggtggactgcgcgccgctgcaaccgctgcgccacatgcagggcggcagcggctgccatatgtgcggccgctgcagcggccatcgcgacgcgatcgagctgagcctgcgcccgtccaacgatgaagtggtgcgggtggcggaaaaagaagccgatggctggcagaccgcgctgatcgtctacggcctgctgggcgtggcgatgggcgccttccactggaccatgagcccctggttcgtatcgctgaagcaagccgcggcggaatggctggtggaccgcgacatcatgtggccgctggacaccggcgcgccgtggtggctgctcactcactacccgcagcacaacgacgtgttctcctggctggacggcgcgtcgctgatcgcctatgtcgccgccaccgcgctggtgctgggcagcggcatcctggcctgcctcgccttgtcggtaaccgtttccggccgctggcacacgcaacgcctgcaccatctggcgcaggcgctgatcccgctggccggctgcggcgtgtttctcggcctgtcggcgctgaccgtcaccctgctgaaggccgaaggcttcgccatgcactgggtcaacgatgcccggctggccttgctggccggcgccaatctgtgggcgctgcggctggcctgcggcattctgtcgcgctggagaggcggcctgagccgcctggcggcgctgctgccgttctgcggcgcgctggcgctggtagactgcgcctggggttatatgttctggtggtggtgacggcgggcatcggcgccgccattccccgctcaacgcccctggccgcgtccgccgcgccaggggcgtttgctatccggcgcggcacggaagcggctcttggttggcgccgcgcgctgtgcgataacacagtatccccgtccgtttaggagccgccatgcggcgtctgctgcctctggttttcgcgctgtcgctcggcggtccggccgctgcccagccggccgtcgagctggccaccggcgagtggccgccctacgtctcgcaaagcctgccgcaggacggcgtgttctcgcagatcgtgcgccaggccttccagcgcgccggctacccggtgcatttcacctatcagagctggccgcaggccgaggcggcggccaaggccggccgggctgcggcggcgtttccctaccggccgacgccggagcgcgagcaggatttcgacttctccgcgccgctgatgcgctccaccagctatctgttctatcacaagccccacatgccgcacccgccgccgcagttcaaatcgttagacgagctgcgcggctaccgcgtcgccgtccagctcggctattggtacattccgctgttccagcagcacaagctcaataccctgctgaccagcgacgaagtcaacgccttgcgccagttgcagctgggccgcctggacctggcgccgatgacgctggagcgcggttttttcctgatccacagcgcgctgcccggacatgaaaaggaattcggctacatcccgacgccgctggacaaggaaacgccgctggggctgatgttctcgcgcggctatccgcaggtggcgcgcatccgcgaggacttcgcccgcgcgctggagtcgatggagaaagacggcacgctgaaggcgatctaccagcgcaacttcccggaagtcacgccgccgcgttgaccagcgtgggattcagcacccggatcacctcctgcgggctgacccctaccaggaagccgcgcttgccgccgttgaggtagatgagcggcagctcggcgatgctggcctccatatacaccggcatcgggtggcgggtgccgaaggggctggtgccgcccacctggtagccgctgtgcttgtcggcggttttcgggtcgcagggatggactttcttcgcgccgatctgcttggccagcatgccggtgcccacctcccggtcgccgtgcatcagcacgatcagcggacgcttgttgtcgtcctccatgatcagcgtcttcaccaccgcgtgctcgtcgacgcccagctcgcgcgccgacaccgtggtgccgcccttgtcctcgtatttgtacaggtgttcggtgtagtcgaccttgtgctcgcgcagcgcgcggacggcctgggtgacgggggccttgctggacatgatgtgttcccgatgcgaaacgccacactttaaaacccggccgccaccttgccaagcggcgggatcaagccttgcgcgcgcgccaccacagccgcaggcccagcaagcaggccagaacagcggcgtagatcagcggctgggtgacatccttcttcaccagccaccagtaatgggtgaccgccaggatcgccaccgggtacaccagccggtgcagcttgccccaattgcgcttcagccgccgcatccagccctgggtggaggtcagcgccagcggcgacatcagcgcgatggcggcgaagccgacggtgatgaacggccgcttggcgatgtccttcaggatgtggtgccagtcgaagaactggtccagccagatataggtggtgaaatgcaggctggcgtagaaaaaggcgaacaggcccagcatgcgccggcatttcagcggccaggcctggccggtcaggcggcgcagcggcgtcatcgccagcgtggccagcagccataccagcgtccaggtgccggtggagcgagtaatgaactccaccgggttcaccgcttcgcccatcagcacgatccacgccgcgcgcatgagcggcagcaggcaggcgatgaacaacaaaaccttgccgacggcgaggcggcggtcggccggggcggcgggcgttttcatgcgcagcgtcgtcatcagtagttctttctcaggtccatgccgcggtacaagccggccacctgctcggcgtagccgttgaacggcagcgtcttgcgcttgaagaattcgccgatgcgccgctcggatgcctggctccagcgcgggtggtcgacatccggattcacattggaataaaagccgtactcatgggcgttggccatattccagctggtggccggcatcgtttcctgcagccggatgcggacgatggacttgatgctcttgaagccgtatttccacggcaccaccagccggatcggcgcgccgttctggttcggcagcgcgttgccgtacaggccgacagcgaggatggccagcggatgcatcgcctcgtcgatgcgcagtccctcgcggtacggccagtccagcaccgcctggcgctggcctggcatctcgctcggccgctgcagcgtctcgaacgacacgtatttggcgcgcgaagtgggattcatctgcttgatcaggctggccagcgggaagcccacccaggggatgaccatgctccagccctcgacgcagcgcagccggtagacgcgctcttccagcggaaacttcagcaactcctcgatggagaagcggcgcggcttggccacctcgccgtccaccagcacgctccacggccgggtatgcaggctgccggcgttctccgccggatcgctcttgtcggtgccgaattcgtaatagttgttatagctggtgatgtccttcaggctgttgggcttgtcattggccgccagctgcgacagcgggcttttcctggcgttgagcccggccagcgtttcggccgacagcaacagtccggcggcgccggccatgaactggcggcggttgaagtacactttttccggcgtgatttccgacggcaagtggtcggcgggttttctgatcagcatggcggcgctcctgtcgtttccacttggtcggctcaacacgctgattctgacaccaggcgggatcaaccgttcagcgttaaagtgttagcaaagactatcccggcccgcttggccggcgccaatgccgtcatgctaaactgcggccgccgccgcggcggcgcttccgtgccgttcacaccaacaattacagatcagacaatgtcatgaagaaacaactcgccatcgccctgaccgtgggcagcctgctgctctgccaatccgccctcgcccgccgcgagccgctggaacagccgcaacgcgtcacccttaccgcgcccaacggcgacgtcggcaaaaccaaggccgccatcatccgcgccgccagcggcctgcaatggaatgtcgtggccgaccagcccggcaagctgaccttcaagcatgtcaaaggcaatatcgtgctggtgctcgatgtcagctatgacgccaccggctatcaggtgcgctacgcgtccagcgaaaacctgagctaccaggaaaccgaaaccggcgcccgcgtccaccccaccgtcaaccgctggatggacaatctggtccgccacatcggcggggaccgcaccgatggcgacgacgacgacaagccggccagcgcggccgagtaagcgcccgcccatgcaaccggccaagcgcctgtccggttgccccgctccccccagccccgcctctttccatgccatccaagctgaaataccagatccaacccgctccggaggtggacaccgccaccttgcgccgcctgcacgcgctgcggctggcgcagtttccgttccgccgcgccgaccccgcgcgcgaagccgccatgtggcgcgaatttcaggatagctatcgacagcgcgccgcctggtcggtgattttccgcgacgccgacggcgcgccgcgcggcttctggctggctgtctgcgagcggccccggccgccggcgccgcgcggcgtgctgctgcgggtggattatttgtataccgaaccgggctggcgcggcagttccgtattgatcgcgtccaccctgaggctgctgtggcggaccaagctgcaagcgcccggcctgcctctatggttcggctgcatctgttttcccaatagtttcatccgggtggcggccaccttcgaacaggtgcgcacgctggccgacgcgccgctggcggccgcggaccgcgccttgctgctgcagctgggcgccgacgccgcgggcgcccgttggcgcgcggccagcggcctcgccgacttcagcgaccatcatccgccggcgctggccgccggcatcgccgacacgccgcgcctggccaggcacttggcccgctacgaagccgccaacccggactggcgccggggcatggccatgccgatgttctgccggatcggcctggccaccgccatccgcggcgtttggcacaccctgcgccgcgcttggcggcgcaaaccggcggcttgaggctacaactggtgccagcccagccagtacagcgcgcagaacagggccgcgctgatcagcagggcgatggccagcgcggaaaacagctcgtgcagcgtgcggcgctggctgggccgcagcagccagcgcgccaccgcccacagcaccaggcacagcacgaaaaacttgaacaggcgtccaaacatgatggcagtcggcgaggaagtgccgcgattatcccggcgcgatctctccccgcgcaagcccggcttgtggatataatcgtccggtagccgcaggagacttcgcccagcctgccccgacagagggcggcggacgaagataattagaagaggccaccaccacttatgaccgacaccaactgttcggtaggcatcgtcgcgccccaggacgccgtgttcgatgtcccattgccgctggcgagcggcgccgtgctgcccagctaccagctgcgcttcgaaacctacggcgcgctcaacgccggccgcagcaacgccatcctgatctgccacgcgctgtccggccaccatcacgccgccggccgccatcacccggacgacaaggccgccggctggtgggacaatatgataggccccggcaagccgatcgacaccgaccgcttcttcgtggtcgccgtcaacaatctgggcggctgccacggcagcaccggcccctccagcgtcaacccggccaccggccagccctggggctccgcctttccggtggtgacggtggcggactgggtgagctcccaggcgcggctggccgaccggctgggcatagagcgctgggccgcggtgataggcggctcgctgggcggcatgcaggcgctgcactggagcatcgcctacccgcagcgcgtcgcccacgcgctggtgatcgcctccgcccccaagctgtcggcgcaaaacatcgccttcaacgacgtggcgcgccaggccatcctcaccgacccggaattccacggcggcgacttctacgcccaaggcgcggtgccgcgccgcggcctcaggctggcgcggatgctgggccacatcacctatctgtccgacgacggcatgggcgagaaattcggccgcatgctgcgctccggcgaataccgtttcggctacgatgtggaattcgagatcgaaagctatctgcgctaccagggcgacaagttttccgactacttcgacgccaacacctacctcttgatgaccaaggcgctcgactacttcgatccggccaaggagcacggcggcgacctggccgccgcgctgcgccaggccagcgccagcttcctggtggccagcttcaccagcgactggcgcttcgcgccggaacgctcgcgcgaaaccgtgaaggcgctgatcgccgccggcaagcgcgtcagctacgccgaaatcgaatcggcgcacggccacgacgccttcctgatgaccgacccaccctatgtggacctgatgcgcgcctacctgtcccgcgtggccgaggaggcgaacgcatgaaccatcccgctctccgccccgacctgcggatcatctacgactggatctcgcccagcagccgggtgctggacctgggctgcggccggggcgaactcctggcggcgctgcaggacggcaagcaagtgcaaggctacggcgtcgatttcgacgtcgccaacgtggtcggctgcgtcgccgccggcgtcaacgccattcagggcgacctggaaactggcctcgccgaattcgaggaccagcgcttcgaccacgtggtgctgtcgcaaacgatacaggcgatgcgccataccgaggccatcctcaacgaaatgctgcgcgtcggccgcgaggccatcgtcagcttccccaatttcggctattggcaaaaccgctggcagatcctgcagggccacatgccggtgtcggacaccattccctaccaatggtacgacacgcccaacatccactggtgcatgctcggcgatttcgaggcgctgtgcgcgaagaacggcatacgcatcgtccagagggtggtcatggacaagggcaagcgggtatccttgttgcccaatctgcgcggcagcctggccttctaccgggtggcgcgcggctgattccgcctcgcacaaggagagatgcatgcgcctgctgctggccattttcctgccctggctgcagttcttcaccataggccggccgttcgccggcctgttctgcctggtcctgcaactgactctcatcggctggattccggccgcgctgtggtcggtgtacgcgctgagccagtacaagaccgaccagaaaatcgccaaggcgctgcggcgctgacgccggcccgggccggccccgaatccggggccggccgcgtcccgcaaccccacaccacaagaaaaccatgaccctggcctccatccactggcggcgcgatgtgttctcccgcgccatgctggtttgcgtattcaccggcttcgcctccggcctgccgctctacaccctgatcaacctgctgccggcctggctgcgcagcgagggcgtcgacctcaaatccataggcctgttcgcgctgatcggcctgccctacacctggaaattcctgtggtcgccgctgatggaccgctacgcgctgccgctgttgggccgccgccgcggctggatgctggccagccagctggcgctgctgttcgccctcgggctattcggcctgttcgacccgcgcgcggacatctggaacatcgccgcgctggcgctggcggtcgcctttttctcggccagccaggacatcgtgctggacgccttccgccgcgaaatcctcagcgatgccgaactggggctgggcaacaccatccacatcaacgcctaccggctggccggcctggtgccgggctcgctgtcgttgattctggccgaccgcatgccctggggcggggtattcgtggtcaccgcgctgttcatgctgcccggcgcgctgatgacgctgctggtgaaagagcccagcctagccgccggcagcccgaagacgctgcgcgaagcggtagtggagccgttccatgagttcgtcacccgccagggctggcagggcgcgctgtggatattgggcttcattttcctgtacaagctgggcgacagcatggccacctcgctggcgacgccgttctatctcgacatgggctacgccaagtcgcagatcggcctggtggccaagcatgccgggctgtggccggcggtggccggcggcctgctgggtgggctgtggatgatcaagatgggcatcaaccgcgcgctgtgggcgttcggcgtggtgcaggtgctgtcgattctgggattcgcctggctggccagccatggccgtttcgacagcgtcggcgccgagcagctcggcatgctggccgcggtgataagcttcgaggcgctgggcgtcggcctcggcaccgccgccttcgtcgccttcatcgcccgcagcacccatccggcctacaccgccacccagttcgcgctgttcaccagtctggccgcggtgccgcgcacgctggccaacgccgccaccggctacatcgtcgactctatcggctggacttcgtttttcttcctgtgcaccgcgctggcgattccgggcatgatgctgctggtgaaagtggcgccctggggcgacgacccggcggccagcaaggcctgagccttcacggccgacactgctcgccgccgccgtcctggcggcactggcggatattgccatcctggtccagcttcagcagccactcctccaggccggaaccggttttcgccctggcctcgatgatgaagctggtctgctcgacattgtcggccgacggcaacgcgctgctgaagccgatatcgaaagcggcggtctcgatcaccggcaatgccggccaggccagcggcccctcctggtgaaacacgccgtgctcgtgataccagcgctgcatgaagtggttgtcctccagcaaggccgagcgcgcctcctccagccgggcgcgctgcaagtatgactggtagcccggcagcgccaccgccagcagcaatgcggcgatcgccatgcagccgaccagttccagcaggctgaagccgccgacatttgtcttcattccctgcgctcctcccagttcaaacgccgccccgccgcctcgccgtcgcccacccggtaccagctttgcagggtgaccgagctgtaaggcgtgcggccccaggcccgcaccgtgatccggtacaaacgcccgggcgatccgtcccgcgccaggaagccgggatcgatcagctccaccacgtagcgcggattggcccagctgagcccgccgctgcgcacttgctgcggacacctggactgcgccggctccggctccagcggaaaggcgcggctgttgccgcagggatgcagcagcggcaccgcgccgttcgcgcggcgttccggcggttccttgggctcgcacaggcccttgccctgcggaccatggcagctgggcggaaacagccggccctcgccatacagctccgccggccgggcggccagggccgccatgtccagccggcggtccagccgccacacccagtcctcggcgcccagcagcgcctgccgcgccaacagctgcgcccgccgccgatcctggacattgtccgccagccgctgcgcgctgatcgtcagctgggacgaggacaaggccagcatgctcagcgccgccagcaaggacaacaccagcaacaaagcgccgccgcgctggcggctggccctcaccgcgcgccttagcatggctgcaacggcgtcagcgccgcgtcatggctcagcttgatcaccttgtcctccccgctatccggataccactccatcgtcacccgcgccgccgccaggcggccggcctcgccagccgtcaacgagtcgatgccgcgccaggcccagcgcgcatccggcccgcagccggtttgcgccagcacccgcagcgacagcgacttcaccccatccaacgccacccgctcgccgccgtcggcgatgccgcccagcgcatcgcgcatcagcaactgccccgatcgccccggacgcagcaggcggtactggcgctgccgcggcagccacagctgcaaagagggcaggtgcaagctgcccgcggccagcgccggagacagctccagcgacggcgtcgccgcgccgccgctccagcttgcctcgcctccggccaagcgcagcgattgtccgcagctgaccagccggctctcgcgccaagcgcgccagtcgctgtcctgcggctccagcagcaggcggctcagtccgcccgcgtcgtccagcaccgcctgccggtgccgcagccagcgcccgggcagcgacagcgtccacgcagtctggccgaaatcctcgcgccgccaggcttcttgcgcgcatcccagacggccgtgcatggacaaatcctgcgccagctgccgcatcgcccagcgcgcctcctgccgccgctccaggccctgtccggccaagcgcaccgcgcggtcggccaccccgtaagacgacaccgcctgcgccagcacgtaagacagcaaggccagcgccaccaattggcccaacaacaaggaaccgcgctgccgcgcgcgttcagggctgcagcggccagacaccggcatgctcctgccattgccggccggcgcggctgcgccaggccacccgtatcgccaactccccctgcgcgccgcagcccggccgggcgagggtgggcggcacgccgccgtcgccgcggcacaccaccgccctcacctgttcggcgcggctgctgcccgcgcgcagcgcctgcttgaaatggccgagatcggcggccgccagctgcgcggaagtgcacggccccgcgcactcgccagccgtcagatgatcgtcatagccgctttccagataatgcggccacaagctgtccggccgggactggatggcgctggccaggtcggccaccgcgtcgtcgatgcggccgcgcagctcggcgtcgcgcacatgctgcagcgaacgcgccagcatgccggccagcgccagcaaggccagcatccacgccagcagcgccaccatggtttccagcaggccgaagccggcctggcgccgcctagccgcaatcatcggacacctctcccagcctggcccgcccatcctcagccagcgtcagcgccaggcactggcggccgccggacagacggaacaccatggcgccggcctcgcgcaagcgtccctccgccgtcagcgtcaattgccgcgccggcgcgcgcacggccactcgggcgccgtcgaacatcgccagcttcaagcgttcgccgctgtcgtaatagccattgccggcgccgcggtcggcgtagaccagcgcgccctccggccaaaccgcctgcggccccgcctgaggcggcaggcagccctgcagctcgcggttgcgtttcagattggccgcgcacagataaaccggctgattgcgccgcaaggcctgggcgcgcgcgtattgcaggctgcccagcaaggccaggccatggccgcgcagccgctgccgctccagcgagcggtcgagcaaaggcagcgcgctgccgctgccgatggcgacgatggccagcacggtcatccattccagcaatgaaatcccggcctgcttggctatgcccatgctttctccgcgaatgacggaacagcccacagtctggaaaaacatcgcgaactccgccgcctcccctgtcccaaagccggaaaacggccatggtcggccagaccaaagttcaggttggaagtgatgcgaaaaggaaaatccccggcggaaccgctggacgaaaaaacggcgtccgcagacgccgttatgatgatttgccgctggcgctcagtgcgccgcctcccagctgtcgccagcgccgacctcggccagcagcggcactttcagcgccgccgcgccggccatgatttccggcaaacgccgcttgaccaactccagctcggcctgcggcacctccagcaccagttcgtcatgcacctgcatgatcagcttgctctgcaagccgtcgcgctccagccaagcctgcaccgcgatcatcgccagcttgatcagatcggcggcggtgccctgcatcggcgcgttgatcgccgcgcgctcggcgccggcgcggcggccaggattggacagcttgatgtcgggcaggtacaggcggcggccgaacaccgtttcgacatagccctgctcgcgcgccttctcgcgggtggtctgcatgtactcggccacgcccggatagcgcatgaagtagcggtcgatgtactgctgggcggcgctgcgctcgatatccaactgggcggccaaaccaaacgcgctcatgccgtagatcaggccgaagttgatcgccttggccgcgcggcgctggtcggacgtgaccgcgccgagatcgacgccgaacacctcggccgcggtggcgcggtggatgtcctcgccgctggcgaaggccttcagcatgccctcgtcgtcggacagatgggccatgatgcgcagctcgatctgcgaatagtcggccgacacgatctgccagccggccggcgcgatgaaggcttcgcgcacgcggcggccctcggcggtgcgcaccgggatgttctgcagattgggatcgttgctggccaggcggccggtgatcgccaccgcctgtgcataagtcgtatgcacgcggccggtctgtggataaatcagcgtcggcagcttgtcggtgtaggtggacttcagcttggccaggccgcgatactccagaatgcacttcggcagcggatggtccagcgccagttgctccagtaccgactcgtcggtggaatagccgccgctcggcgtcttcttgacgcccttggtcgggatcgccagcttgccgaacaggatctcctgcagctgtttgggcgagttcagattgaatggctggccggccagctcgtaagcttgctgctccagttccagcatctggctgcccagttggtggctctgcgccgccagcttgtcgcggtcgatcagcacgccgtggcgttccatcttgaacagcacttcggccaccggcagctcgatgtcgcggtagaccttttccagatcgccggacagctcgccggcgaaatactggttgagcctgagcgtgatgtcggcgtcctccgccgaataattggcggcgatgtcgacgtccacctcgccgaaaccgatctgcttggcgcccttgccgcagatgtcctcgtagctgacggtgttctcgcccagatggcggcgcgccagatcgtccatattgtggcgctggtggctttccagcacgtaggaggccagcatcgaatcatcggcgatgccgcgcagggcgatgccgtggttggccagcacgtggcagtcgtacttcaggttctgtccgcactttttctggctggcgtcctccagccacggcttgagcttggccagcgcggcatccagccccagctgctccggcgcgccggcgtagtggtggtccagcggcaggtaggcggcatggccggcctccaccgagaaactgacgccgacgatgcgcgcctgcatcggatcgaggctggtggtttcggtgtcgaacgacaccaccctggccgccgccagtttttccagccaggcgtccagctgggcttcggtcaatatcgtttcgtaatggcgcgtcagcgcggcttcggccggggcggcttgggccgccggcgctgcggccggttcggcgaacatgtcgccctgggcctgatcgccgcgcggcgcggcgggcgcgtcctcgccgcgctgggcgacagccggcatctccgccccctcggtcacctcgcggtagaaggtgcggaagcccagatcctggaacagctcggccagccgcggcttgtccttccggccgtgctgcaggcccggcaggccgtgcggcaagtccgtcgccaggttcacctcgcaatcgatggtgatcagccgcttgcccatcggcagccagtccagcgcggcgcgcaggttctcgcccaccttgccgccgacgctatcggcctgggcgacgatggcgtccaggctgccgtattcctccagccacttcaccgcggtcttcggcccgcacttgtcgacgccgggcacattgtcgaccttgtcgccgatcagggtcaggtagtcgatgatccggttcggcggcacgccgaacttctccttcaccccggcttcgtccagcagctcgttggtcatggtgttgaccagggtgacatctggcgtcaccagctgcgccatgtccttgtcgccagtggagacgatcaccttcatgccggccgccgcgcccaggcgcgccagcgtgccgatcacgtcgtccgcctccacccccggcaccaccagcatcggccagccggaggcttgcaccacgtcgtggaccgccgtaatctgggaggcaagctcctcgggcatcgacgggcgattggccttgtattcggggtacaggtcgtcgcggaaggtcttgcccttcgcgtcgaagacgcaggcgctataatcgaattcaacctccttctccagccgcctgagcatgttcaccatgccatagacagcccccaccgggcggccatccggggaacgcaaatcgggcatcgcgtgaaaggcgcggtacaagtaagaagagccgtcgatcaataacaatgttttcataaagaggcagaagtatgagcttgtccgataagttgccgcagaccagtgaccgtcacgccatgatgcagcgcttccgttcccgcgaggcctggcacgtgatgaagatattgtcggagtttgtcgagtcggccgaggaactgcaaggcattaccccggcggtgagcatattcggcagcgcgcgcacgccgcgcgatcacaaatactacaaattgaccgaggacgtggcgcggcgtctgtccgattccggcttctcggtgatatccggcggcggccccggcatcatggaggccgccaacaagggggcattttacggcagaagtccgtcggtggcgctcaacatcgtgctgccacacgaacaaaaacccaacgattaccaggacctgtcggtcaagttcaaccacttcttcagccgcaaggtgatgttcgtcaagcacgcgatcgcctacgtagtgatgcccggcggcttcggcacgctggacgagatgttcgaggcgctgacgctgatccagaccggcaagagccgcaagattcccatcatcctgtgctgcagcgaattctggaccggcctcttggactgggtgaaagaccgcctggtcagcgaaggcatgatcaacccggacgacctcaacctgatccagctgatcgacgacccgcagcagatcgtcgacaccattttcaaacactacgagacccgcggcttcgacgccttgcccgaagagcgcgagcagctgctcaacctgtaaccaccgcataccaatcaataaggacaaaccatgcgccgcctcaccgccctgcttctactcctgccgctggcccccgccttcgccgccgacgcctccgcgccggccaaggcggtggtgcctccgccccccatcatcagccaggacaactccgcagaacccgagccggaagtgcggctgatccagaaaggcgacgagaagatcgaggaataccggctgaacggccagttgtacatggtgaaggtgacgccagggcacggcgtgccgtattacctgatcgacgacaacggctccggcaccatgaagcaggtcgaccccgccacccgcatcatgatcccgcgctgggtgctggttcgtttctgaggagcaggcatgtcggtttacaccacggtcagccgcgaaagcctgcagcaatggctgcagggctatgcgctgggccagctgctggagctgcaaggcatcgcggcgggcatcaccaataccaattatttcgtcaccaccacgcacggccgctatgtgctgacgctgttcgaaaccctgcaactggacgaactgccgttctacctgtcgctgatgagccatctggccaggcacggcgtggcctgccccgcccccatcgccgaccacaccgaccgcttcgcttcgacgctggccggcaaaccggcctgcctggtcacctgcctgcagggcgcggacgtcagcgcgcccacggccgcccattgccgcgcagtcggcgaaatgctggcgcagatgcacaaagcctccgccaccttcccgctgaaaatgcagaacccgcgcggaccgcgctggtggagccgcgtcgcgcagcagctatacccgcagctgccggccgaggaagcggacttgctgcgcgccgaaatccagtttcaggacgggcaccgcttcgaccatctgccgtccggcgtgatccacgccgacctgttccgcgacaacgtgctgatgaacggcgagcagatcgccggcttcatcgacttctactacgcctgcaacgacatcctgctgtacgacgtggcgatcgcggtcaacgactgggcgcgccgcgacgacggcagcctggacgacgcgctggcgaaagcgctgctggacggctaccagtcggagcggcagctgaatccggacgagcgcgccagctggccggtgatgctgcgcgccgccgcgctgcgcttctgggtttcgcggctgcaggatctttaccagccggccagcggagaactgacctataccaaggaccccgcggttttccggcaactgttgcgagaccacggccaacgcacggtcttctggctggattgaccgccttttccgatggccgcattgccatgttcacaatgttgtcatcggattccacttgaaaagtgtgaaaattcacttaacatcagtgatgagtagtagctgttttccggattcccgtagttcaacctgagcaaaggattcatcatgctgctaaaaaaaatcatcaccgttaccctggccgtcatgctcgctagcccggcgttcgccgccggcgaagaaaccgtcggcggcactgccggaaccgcaggcacggccggcaccgccaccgccggcaccgcaggcatcgccggcaccaccgccggcatcgcgggcctcagcgtcggcaccatcgccgccatcggcgcagccgtcgccgccgccgtcgcagtctccagcaacagcaactcctcgtcctcccactccgccgccacgcaccactaagcgccggagcgccgtgattacgcggctcctcgccaggcaggcggatggctgtcatcacgcctgccggctttgactctcaaaactaaaaaatagcaaagcatcgcatagtgtcgtttgcgtgatatgaaacgcagcaaaaatctgccgccagcaaggccgtatgattgacgcgactcaaggggctgttctgaaaacttgatccattccgcatctccgccaaccgcgcgccgtcagaaaatgcgccgcggcggcgggcgcgcacaggatcatcctcttggttttccgcttcccctggcccgttggcgatggatacaagggggccgcctttcaggccggcaataagcagcgatggctgcatcgaataaatccaggccgcagcaatgcagaacaaatccagacgctatctggcttcgggggtgttacaagggggcttgccgctgcttttcgcctgcagcgccatcgcccaaccatcgctgaccgggcagatgggctatgtcaacatgccgtcggcccgcgtcggcgaagacggcaccttcagccttggctacggctatgacaagccgtacggcgtgctatggacttccaccacggtgctgccctggctggaagtgtcgggacgctacacgtccatctccggcattcccggtttcgacaatccgcaatatggcggcaattacggcaggtacaaagacaaggccatagacttgaaattcaagctgtgggacgaatccgcgctgatgccggaaatctcgctgggcacgaccgacatcgtcggcaaccggctatggaaaagcacctatctggtcgccagcaagaatctgctgcccggcctggaggcttcgctgggctatggcaaggaccgcatacaaggcgcattcggcggcctgcgctatacgccgcaagcgctgcccaactggtcgctggtcgccgagtacgacgccaacaactaccggcaggatccctacgaatccagcacgctggccgccgaccggaaaaaaggcccggtggtcggcatcgaataccaatggggctggctgggcctgcaagtcgcccggcagaaaaccctcaacagcgtcaatgcccacatcgacatcccgctgaacgtgaaggagttcgtgcccaagatccaggagcctgactacttccgcggcggccccgacctgccttcacgccccacgctggcgcaatggaaggacagcggcgactacgccagccagctggcgaccgcgctcgccaagcaggacttcaagaacatccgcatcgccatgcagcgcgacgcgctggtgctggagctgagcaacagccgcatctccaatgtcggccgcgctgtaggccgcgccgtgcgcaccgcgctctatttcgcgccgctggaaacgcgcgaaatcaaggtggtttacaccgagttcgagcagccggtcgccacatacagcttttacgacatgcccacgctcaacgactacttgctgggcaaggccaaccgcgcccgcttcctggaaaccgtcaacatccgtccgggccgcgacgaggaaacccagccgctggccagccagtcgctggcccaaggcctgaaggaaagcatccagctcaacctgctgaccaaccaggagggcgacctggttcaagtcaccagcaacgacgccgaagacaaccatttccacatggcgccgaaattcggcgtctatttcaacgaccccagcggcgccttccactacgacatcatggccgaggccacctacaagcgccggctcgccaagggcctgtatctggacagcgcgctgagcgccgacctctacaacaccatcaccgccgtgacgcaaccgtccaacagcctgctgccgcacgtgcgctccgatatcgccgactacaagcgcgtcaaggcgcccaagctgaaccgcttcatgctcaaccagtacatgacgctgtcgcccaatacctatgcccgggcttccgtcggcatctacgaggaaatgtaccgcggcgccggcggccagatcctctactaccccggcgtgaagaactgggcggtggacttgaccgtggacgcgctgcagcaacgcgacgtccagggctggttcggcaagcgcgactaccagaccatcaccgcgctcgccgccatgcactaccaactgccgctgggcgtcaccgccaccgtgcgcgccggccgcttcctggccaaggacgacggcgcgcggctggagttgaagcgccgcttccactcgggcatagaggccggcttctggtacaccaagaccaacggcaacgacatcaccagccccggcacgccgtccaagccatacaacgacaaggggatgttcttcaccattccgctcaacagcctgctgaccttcgacagccgcaccgccggcgacttctcgctgtcgccgtggacccgcgacgtcggccagatggtgatgacgcctggcgacttgtacgaaatcctcagcgacccgaagcgcgacatcaacgcctacgacggcctgggcaatttcgccgaacgccccgacgagcagaacctgcccgcggtcaatccgccgcagcccagctaccacccgtggccgatgatccggatgcggctggaagattccggcactcagtggctgcaaatggacgacaaggccgccgcgctgggcaccatcggcttcgccaccctgaccgcgatggcgctggaccggtcggtcaatcgcgctttccaacagcatgagcagaaccgcctggtgaaggactggggcaagctcggcaaggacctgccctacgccgcggcggccctgtccggcgcggcgttcgcattgggcgacgacaggctgagcaacactggcttgatcgcgctggaatccagcgccgcggcagtggcaggcagcgagctgctcaaaggcttggtcaaccgcgcgcggcccgacgccggcgccggtccctggagcacccagccgtcgggagaatcccggctgcaaagcagcttcacctcgaaccacgccgccgtgctgttcgccgccgtcaccccgttcgccaaagaatacgaccagccctggctgtacggcgtcgccgccttcggctcggtcggccggctggccagccgcgaccactggctgtccgacgtcaccgtcggcggcttcctcggctacctggtgggcaactggctgtggcaggcccagcgcgacgacagccgttaccgcagcaatgtgatcgtcagccccaagcaggtaggggtgcagcttcagatacccatccaataagtctcaatagcgggaagccaagccatgactgcaagcatcttgaaatcgagcggaaaaaccctattggcgctatgcctgctggcgatcagcagctgcccgcaggccgccggcggcggcaacgtcagctaccccagcaccaccatgcccggctatgaaaccgacaacaacaacgggctccccgcgatcaacagcctgcccaccggccagcaggcattcgacaagccattcccgcaactacaacaacagaacggccggagcaaccaggcttatccgcagcgcaaccagccttatctcgacgacaacggctacgaactgaacccgttgaacggcaaacccaagctgccgccgttcgccgactatgtccagaaagccaccgagcagaccctgccgattttcggtagcaagctgttccgcaacccgtacaacaatttcgagtcggcggacggcgtgcaggtcaatcccgactacgtgatcggcaacggcgaccagctgcaaatcaagggctggggcatggtggacatcgatctgaccatgacggtggaccgcaacggcgcgatctacctgccgcgcgtcggcagcgtcgccgtcgccggggtgcgctaccgcgatctgcaaggcgtgctgaagaaaagcgtcagccgggtattcaacaatttcgacctcagcgtcagcctggtgcaaagccgctcggtgcaggtgtatgtggtgggccatgcccgccagcccggcagctataccctcaacgcgatgagcacgctgctgaacgccctgctgaaggccggcgggccggacgacagcggcagcctgcgccgcgtcgcgctgatgcgcggcggcaaggaggtcgccaaggtcgacctgtacgcgatcctggtggatggcgacaagtcagaggatcaaaccctgcgcgatggcgacgtgatccagattcccgccgccggcccgcgcgtggccctgctcggcgacgtcaagattccggccatctacgaattccgcgatggcgacaacgtcggcaacctgctgcactgggccggcggcctggagtccgccgccgaaggcaaggagttgtggatagaaaagagcgtgaacaaccgcttcctcaatctggcgcatgtgcagaacgacgatcggcagctgtccggcatcgcgctgaaggccggcgacatcttccgtctgcacgtgccaggcgcgcagccggtaagcgtgcagaagaacgacgaattcgtcagcgtcggcggcgaagtcggccacaccggcaccttccagatccagaaaggcgaaaccttgcgccagctgatcatgcgcctcggcggcgtcaacgatgacggctatgtgttcgccacccagttcaaacgcgaaagcatacgccagatgcaacagcaaaaactggacgaagtgtccgcccgcttcgagaaggagctggagcaaaacgccgccggccgcctcggcaagctgaccgacaaggacgcgatcgcctcggtgacggccgaggtggagcgccagcgccagatcgccgccaaaatgcgcgaaatcaaggccgaaggacgcgtggtgctggagatgaaagatgccaacgcccaggtcaaggacctgccggatctggagctgcaggatggcgaccaggtggaaatcccgcgccggcccggcacggtcaacgtgctgggcgcggtctaccagagcaacgccttcatctaccggccgcaacgctcggtcagcgactacctgacgctggccggcggcgtggtggacagcggcgacaagtcgtcgatctacgtgctacgcgccgacggcaccgtggccagcagcaacaatggcagctggttctccggagtcggcggcaaacgcatcaatccgggcgataccatcgtcgtgccggaagaactgaacgccggcagctggacccagtcgttgaaggagtggacctccatcctgtatcagttcggcctcggcgccgcaggcctgaaagtgctgaagtgagcatgaacccgacagcgaaggagacgcagatgcaaaccgcaaccgatgggcgcgccaaggacgaagtcgacctgccgaccctgctggcgcagctggcgcgccacaagcgctggatcgcctccagcaccttgctgttcggcgcggcggcgctggcctattgcctgctggcgaaaccggttttcaccgccaccaccagcatcatgcccccgcagcagcaaaacaacggcatgagcgcgctgctgggccagctgggcgggctggccggcgccgccggcggccttaccggcctgaaaagcccgaacgacctctatatcggcatgctgcaaagccgcagcgtggccgacaagctgatccaacgctaccagttgaaacagcgctaccagcaggacaccatggacgcgacgcgcaaggcgctgcaaagcctgagcagcttcgccaacggcaaggacggactgatcagcatcagcgtcgacgacggcgaccccaaattcgccgcggcgctggcgaatggctacgtcgaggagctgaaggcggtgaaccagtcgctggcggtgaccgacgccgccaaacgccgcctgttcttcgaacagcagctgaagcaaaccaaagacctgctgaccgaagccgaaagcgaactgcgcaaaacccaggaaaaaaccggcatggtattgccggaaggccaactgccggcgatcgtcggctcggtcacccagctgcgcaccaatatcgccgccaaagaagtgcagctggaagcgatgaagagcttcgccaccgcgcagaacccgctctacatccgcgccgagcaggagctggccggcctgcgcgagcagctcgccaaactggaaaccggcgacggcaacggccgggacatgctggtgccaaccggcaaggtagcgcaaagcgggctggaatacctgcgccggctgcgcgaagtcaaatatcaggaaaccattttcgaactgctgtccaagcaatacgagctggcgcggatagacgaggccaaggactcctcgctgatccaggtgttggacgccgccgtgccgccggagctgagaagcaagccgaaacgcagcctggtgctggcgcttggcctgttcgccggcttgctggtcggcaccctggccgctctgctgcgggcccggctggacgagcgcggcgcgcggcgcggcccatcccaggccgaacccgcgttcgcgctgaagaacaacggctgagcggcgcgcggcccgcccacgcggctggccgcgcccttcagcgtcctatcgcccgcatccgcaagcggtagcccatccggcagacaaaacccagcgccaacagcacgcacatcgcgcaggccagccgcagcgggctgccccaggccagcggcgccagcgcccccgccaccaggctggacatcatggtctggcagaacccttgcagcgaagacaccgtgccgcgcaacgaaggaaactggtccatcagattgagcgtgatggacggcgccgccagcgacatgccggtggtgtacagcgccagcggcagcaccgcccacggcagcgtcagctgatccgccgccaggttgtaggccagattggccagcgccgcggcgaacatcagccaatagccgcgcgacacgatttcgcgctgagaggcatggcccgccattctgccggacaggtaggcgccgaacatgatgccggacaccaccgggccgaacatccacagaaactggctgggccccaggtgcaggtgctgcatcaggaataccggcgccgacggcacatacaggaagaaaccggcgaagttgaacgacaccgccgccgtcagcagctggaaatcgcgctttttgcccacctgccagtaattggccagcagataacggaccttcagcggctgccgcgcctcgcgatggtggctttcctccaggccgaaccagcacaaggcgaacaaggcgaagccgaccaaggccatgaacacgaagatggagtgccagccgaaggcgccgaacaaccagccgcccaccaccggcgcaatcgccggcgacaaggaaaacagcatggtcacatgcgacatcagccgctgcgcctcggcgccgtccagcttgtcgcggataatcgcccggccgaccaccaggccggcgccgccgcacaagccctgcaagccacggaacagcagcagcatgcccaggctgtcagacagcgcgcagccaagcgaagccaggccgaacagcagcgtggtggccagcactaccggccggcgccctatcgcgtcggaaatggacccgtgccacagcatcatcaacgcgtaacagaacagataaaccgtcagcgcctgctgcatctgcagcggcgaggccgccaggctgtcgccgatggcccgcatcgcgggcaggaaggtatcgatggagaagggaccgatggtggatagagctgccagcaggaaaaccaggccgaaatggctgcgcgcggatgaggacatggaaaaataatcatagataatattgtcatgttaacgataagcaccccgcttgccaaacaccagccgcaaagcttggcaggctcggcctttcatgccacgatgccgctaccttccacacgcgcagcgagcggattccgccgccataacaagggagaagcccgatgatccgtctttaccacaatcccaagtgttcgaaatcgcgcgcggcgctggccctgctggaagaagcgggcgccgaagtcgaagtcgtcgaatacctgaagcacccccccagcgccgaagagctggaccgactgctgcagctgttgggcatggagccgcgcgagctgatgcgccagaaagaggaagaatacgccgacctctaccttgacgacatcacgctggaacgcaaacacctgatcgccgcgatggtggacaacccgaatctgatcgagcgcccgatcgcggtgggcgacggccgcgccgtcgtcggccggccgccggagcaggtgctgctcctgctgtcccgctaagtttcccgctttccccctgcggcctgccctccggcaggccgtttcgcattccgttccccatccgccaatcatgccaacgacattgacgcaacagtctaagctggcaagtcattagtgaggttattatttcttgcaaaataataccgcgcgttactaaaatatccacatgagcccaaacaagtcctttgcccaactggaacaggcgatcaaccatgtcgaggcccgcttccccggcgtgccgcgccaggaagtgatcctcacccggctgattttccatatcgtgccgcggctgagcgcccacatgtgcgagagcctgaagcagcacggcctgaacgaaaccgtctggatggcgctgttggcgctgtacgcctgcccgaaccaggcgctcaatcccagcgacatcagcgagacgctggactcctcccgcaccaatgccacccgcatcgccgacgagctggtgaagaacggctgggccgcgcgctccgccagttccgaagaccgccgcaagatcgtgctggaactcaccgccgccggcgtggcgctggtggaaagcctgctgccctactcgcgcgaagtccacaaaaccctgtgggccgacttcgacagcgaggagaaagcgctgctggaacgactgatgcgcaagctgctgagcaaactcggcggctgaatccgcaagcacttttttcgctcaaataataaccagtgtgattatcatcagatatatcactgcatcgcatacatcattgatggagaccgacaaggtgaacaagaaatcttggccacagaccgccggggtgctgctgatcagcgccgtgctcggcggctgcgccagcttcggccccgatgtcacccccgatcaggcgctgagcgccgaacagctgaagctggccgcccccggcaaacagaacctgagcggcaactggtggcagcaactgaacgacccggcgctgaaccagctggtggacagcgcgctgaaagacgcgccgtcgctgaagctggccgccgcgcgcctgcgccaggcccgcgccgccgtcggcatcgtggaaagcaaggatggcccgcagctggacgccaccgccaatgtcgcgcaaatccacaccgaccagctcaagccgctgctgcatgaagactacgtcaccgcctacaccgcggcgctggtcggcagctgggaattcgatttctggggcaagaaccacgccgcggtcagcgccgcgctgggccagcagcaggccatcgctttcgaaggcgagcaaacccggctgatgctgacccaggcggtgatcgcccaatacacccagctgcagcgcagccaggcccaggccgatctgctggcccagcggctggccatcgcgcaaagccgcgagaagctgacccaggcccgcatcaacgccggcctcctgcccggcgacaatcagcgcggcaacgaagtgtcgatcgaaaaactgctgcagcagcaaagcgcgttcgccaacgacatcgagcgcagccgccacgcgctggccgcgctgaccggccaggggccgcaagcgcaagccgcgccgcagccgggcaaactcgatccggcgccggcgccgcagctggacagcctggacgccaacctgctgggccgccgtcccgacatcgccgcccagcgcgcgcgcgtcgaggcgatggacagctcggtcaaggaagcccgcgccgagttctaccccaatgtgaagctgacggtgttcgccggccagacctcgctggaaatggaccaactgttcaagagcggctcctcgctgtggggcttcatgccggcgatcaacctgccgctgttccactccggccagttgcaatccaacctgtccaaacagcaggccggctacgacatggcggtgcagcagtacaaccagaccgtgctggacgcgctgcgcgacgccgccgactcggtgtccggctggcagaacagccagcgccagctgaagcaggccgaacgcgcgctggccagcagcctcaaggccaacgacgcgatggcatcgcgcctgcgcgccggcctggtcaacaagctgtcgctgctggacgcgcaagacgcgctgctcggccagcaatccgcctacatcgacgccaaggccgccaaccgtctggcctgggcctccctgaacaccgcgctcggcggcggcttccaagcccagcccgccagccactaaggacatcatcgcaatggatcagaaactagaaaccgcgcaaagccgcaaacgcaatctgctggtcgccaccaccctgttcgccgccatcgccatcggctacggcgcttactggagcctggtgctcagccaccaggaaaacaccgacgacgcctatgtcgccggccatctggtgcaggtcaccccggaagtcggcggcaccgtcgccaaggtgctggtggacgacacccaggcagtcaaggccggccaggtgctggtcagctacgacaacagcgacgccgagctggccttcgagcgcgcccgcaacgaattcgcccagaccgtgcgccagacccgccagctgatggccaatacccagcagctggacgcccaggtggcgctgcgccaggccgagctatcccgcgccgaagccgacctgaagcgccgcaagctgctggccggcagcgaagcgatgtcggctgaagagctgggccacgccggcgacgccgtcgccgccgcccaggccgcgctgaccgccgcccaggaacaggccaaggccggcctggcgctggtgggcaaggacgcgctggcgcagcagccggcggtgaaggccgccgccagccgcctgaaggaagcctggctcaatctgcagcgcaccgagatcaaggcgccgctggccggcaccatcgcgcgccgcaacgtgcaagtgggccagcgcatcgccgccggcacgccgctgatggcggtggtgccgctggaaaacctgtgggtggacgccaacttcaaggaaggccagctggccaagatccgcgtcggccagccggtggagatcaagtcagatctctacggcggcaaggtggtctaccacggcaaggtgcaaggcctgtccgccggcagcggcagcgccttctcgctactgccgccgcaaaacgccaccggcaactggatcaaggtggtgcagcgcgtgccggtgcgcatcgcgctggacccgcaggaactgaaagaccacccgctgcgcgtcggcctgtcgatagacgcggtagtggacaccagcaaccaggacggcaaatcactggccgaagccgcgccggccgccgccgccagcgaaaacaacaacacgttgcccgacctgaagcaggcggacaagctggtggccgagatcctggccgccaacgccgctgccggcaagtaaggaatccgtcgccatgaaccatccgccactgaccggctcgaaactggtctggatcacgctggcgctgtcgatgtcggtgttcatgcaggtgctggacaccaccatcgccaacgtggcgctgcccaccatttcgggcaacctgggcgccgccaccagccagggcacctgggtgatcacctcgttcggcgtggccaacgccatctcggtgccgttgaccggctggctggccaagcgcttcggcgaggtgaagctgttcaccgcctccaccttgctgttcgtgctgacctcctggctgtgcggcatgtccagcagcctggaaatgctgatcctgttccgcgtgctgcaaggcgcggtggccggcccgatgattccgctgtcgcagagcctgctgctgtcgtgctatccaccggcgaagaaaggcatggcactggcgctatgggcgatgacggtgatcgtcgcgccggtgttcggcccgattctgggcggcgtcatcagcgacaactggcactggggctggatcttcttcatcaacgtgccggtgggcctcgccgccgccttcatttcctggcgcatcctgaagccgcgcgaaaccgacaccgtcgacctgccgatcgacaagatcggcctggccttgctggtgatcggcgtcggctcgctgcagatggtgctggaccgcggcaaggagctggactggttcaactccgccgaggtcgtcaccctggcggtggtcgccgcgctggcgctggtctacctggtgatctgggagctgggcgaggaacaccccatcgtcgacctgtcgctgttcagccagcgcaacttcaccgtcggcaccgtcgccatcagcctgggcttcatgctgtacttcggcgccgtggtgctgctgcccttgatgctgcagacccagctgggctacaccgccacctgggccggcctcgccgccgcgccgatcggcctgatcccggtggtgctgtcgcccatcatcggtaagaacgcgcaccgctgggacatgcgctgggtggtgacggtcagcttcagcgtctacgcgatctgcttcttctggcgcagcaacttcaacaccgacatggacttctcctacgtggtgtggccgcaggtggtgcaaggcataggcgtggcctgcttcttcatgccgctgaccaccatcacgctgtccggcctgcatccgtcgcggatcgccagcgcgtccagcctgtcgaatttcctgcgcatcctggcgggcagcatcggcacctcgatcaccaccacgatgtgggaccgccgcgaggcgctgcaccactccaagctgaccgaacacgtgacgcaatacgatccggagtcggtgtcttggttcggcgccatgagcaagctgggcctgaaccccggccaacagcaggcgctgacccagctgcaggtcaccaagcagggctacatcatggccgccaacgagatcttctgggtctccggcatcctgttcgtgctgctgatcgcgctggtgtggctcgccaagccgccgttcaccgccgccggcggcgacagcggcgcgcactgagcgccagcgccaaggaaacgggcaaagcttcgcggctttgcccgtttttcattgcagatggccgccgaaggccgccatgccgcggctggccgacttgtcgcggtgctgcacccggtacagcgtgcgcgtcagcggcggcaggtcggcgtccaccgccgccaccgcgccggcggccagcagatcggcgatcacatggcgcgacaggcagctgacgcccagccccgccgccaccgcgtgcttgatcgcctcggagtggcccagctccatgctgatcgccagccggctcaaatgcggcagcagcacccgctcgacctcctcgcgggtgccggagccggcctcgcgcagtatccattccgcctgcgccaattccgccgccgccaccttgcgcccggccagcggatggccggcggcggcgaacacgatcagctcgtcctgccgccacgggctggccagcagttccggatggtggcacgggccttctatcaggccgaagtccacgcggaaagccgccaccgcctcgacgatgtcgcgggtattggccacctccagctccagccgcgcccgcggccagtcgcggcggaaggccgccagcagcggcggcagcaggtaattggcgatggtggtgctggcgccgacgcgcagcgccagcgcgtcgccgtcgaacaggccctgcacatcggcggccgcgtccagcaaggcgcgcgcgcgcggcagcagcagccggccatgctcgttgagcagcagccggcgccccacccggtcgaacagctgcgcgccgagcccctgttccagcttgcacagcgcctggctggcggccgattgcgtcagcgccacccggtcggcggcgcgcgtcaccgtgtccagctccgccaccgccacgaatacctccagctcgcgcaggctgatatgcaggctcatccgtgtctccgccatcaattaatcgatttttctactgatatctattaattttatctgtttttctactgatatacagcggtgtatcttggtcatatagcaaagaggcattaacttatgaccaaacattcaaacatcctgcccggcctgctgctggcgctgggcctggccgccgccgccatctgggccgccgagctgccggcgatgaaaagcctgggcctgtccgccctcaccctcgccatcgtcggcggcatggtgatcggcaacaccgtttaccgcttcatcgccggccccagccaccacggcatcgccttttccaagcaaaagctgctgcgcgccggcatcatcctgttcggcttcaagctgacctttcaggacatcgccgccgtcggcttctccggcgtgctgatcgacgcgctggtgctgacttccaccttcctgctggcgttttgggtcggccgcaacaagctgggcctggacgagcagagcgtgatcctgatcggcgccggcagctcgatctgcggcgcggcggcggtgctggccaccgagccggtgctgaaggcgcacgccgagaaagtggcggtagcggtggccaccgtggtggtgttcggcaccgcggcgatgttcctgtggccgctgatgtacgaggcggtgcgctatctgggcatttccgaattcagctacggcctgttcgccggctccaccatccatgaagtcgcccaggcggtcgccgccggcaagtcggtcagcgacgcggcgatgaacaccgccgtcatcaccaagatgatacgggtgatgatgctggcgccgttcctgatcggcctgtccgcctggctggcgaagcggcaccgcggcaacagccacgagaagaccggcatcaccatcccctggttcgccgtcgccttcctcgccgtggccggactcaactccttcaacctgctgccgcacgcgctgctgcgacagatcatcgcgctggacaacctgctcttggccgccgcgatgggcgcgctgggcatcaccacccacctgtcggccatccgccaggccggcagcaagccgctgctgctcgccagcatgctgttcggctggctgatcgtcggcggcgggctgatcaatgccggcgtggccatgctgatccgctgaagcctttgccggcgcgtcgcgccgggtcgttttaccgggacactatcgtcatataagatattgccaatttattgacatagattccccgcatgcgacactggatcatcgccctgctggccctgctgctgggcacggccgccgacggcatcgagctggggctgagcctggcagccatcgccggcatcgtcagcctggccttcggcaaatccgccggcgccggcggcaatagcgaaatcattcccggccaaccgccttcccgcgccctgaccttatggcagatgcagcagcggctggaggcgctggagatagaagtggagttgctgcgcgagcaagcgcgcgcccgctcagacgccgccccggccgctcccgactacagctggcggcccgtggagccggacgaagcgccgccgcctgccccgcaggaacctccgccgctccccgcgccagaacctcctccccaggagccgccgctcgagatcgagtgggaagaggtcgggccgcctcatgcccagaccccgccggcgcctcaacccgtccgcgccgcgccggacatcgcgcccgcaagaccctccgctcccaccctgctggagcgcggctggcagtacgcgcgcgcctggctgctgggcggcaatagcgtggtgcgggtcggcatgctgctgctgttcttcggcttcgccttcctgctcaaatacgcggccgacaacagcctgctgccgatagaactgcgcctggccggcgtggcgctgggcggttgcgcgctgctggccgccggctggcggctacggctgaagcgccgcggctacgcgctgatcctgcaaggcggcggagtcggcacgctgtacatcaccgccttcgtcacgctgaagttcttccagctgttgccgccgggcctgacgttggccttcctggtgctgctcggcgccgccagcgcctggctggcgatacgccaggacgcgccgtcgttggccgggatgggcatcaccggcggcttcctcgccccgatcctcacctcgaccggcggcggcagccacgtgctgctgttcagctactacgcgctgctcaacgccggcatcttcggcatcgcctggcgcaggtcctggcgcagcctgaacctgctgggattctccttcaccttcgtcatcgccaccgcctggggcgtgttgcagtaccagccggagcagctggccagcacgctgcccttcctggcactgttcttcggcttctacctcggcatcgccgtgctgtacgggctgcgccagggcctggccctgcgccattacgtcgacggcacactggtattcggcacgccgctggtcaccgccgggctggcggccggcctgctgcgccataccgatttcggcatggcctggttcgcgctggcgttggccgcggtctatctgctgctgaccttctggctgcgccgccgcgccgccttgccgctgctggcggaatgcttcctggcgttgggcgtgatcttcgccacgctggcggtgccgctggccttcgatggccgcgtcaccaccgcgctgtgggcggtggaaggcgccggcctgctgtgggtcagcctgcgccagaatcgccgcctcggcctctggttcgccctaggcctgcagctgtgcgccggcgccgcctgcctgagccatctgcccgcccaggccgctggctggccggtgctgaacgcttcgttgatcgcctgcctgctgctggcagcctccgggctgttcagcggctggcagttgcaacgccgcggcggaaacgccgccgtgccgccgtcctggctggccgtctgggccggcctgtggtggctgggcggcggcatccgcgaattgaagctgtacctgccggccggttacctggccgatggcgtcatgctgctgctctgcgccagcgcgctggcttgcggcctactgcggcgccggctggactggaagctgctcgcctatccggcgctggcgctgccggcgctgacgctgggctggagcctgctcggcgccttgccttacctgcagcggctgtcggaactgggttggctggcggcgcccgccgcgctggccgcttcgctatggctgctgcgccgccacgaagaggaaaccgccgacgccggctggctgcacgcctgctggcaatgggcgctggtcgcgctgctggcgcgcgaagccggcggctggctgtggcaatggctgccggacggcgtctggcgccacgtggccttcccgttcgcggccagcgcgctgctgttgctgggcggaccgctgagccggctggaatggccggtgcgccgccaccgcgccgcctacctaggctacggcccagcgccgctcttcccggcgctggcgggctggatgctatggtcgctgctgtccgatggcaatccagccccgctgccgtggctgccgctgctcaatccgctggacctcgccgtcggcttcagcctgctggcgctgtgcgcctggctgctgcgcctgaaccggcactggccgacgcagccgcgcgccgcggccgcctggctgctgtgcccggccatcctgctggcggtcagcgccgatgtgctgcgcgccttccatcactgggccggcctgccctattcgctggacatgctgtggagcgcttccgacagccgcatcgttctggcgctgggctggtgcgcgctggcgctgctggcgccgcggctggcggccggccgcgagagcggccgcgtcgtcgcctggtggagcgcggccgccggcgccgtcctgctgctgtggatgctgctggccaatttggaaaccggctcgccgctgctgctgccgtggctgcccttgctcaacccgctggagctggcgcaactggcggtgctggcctgcgtctggctcaactggcgccgcgccggcttcccccgcccccgctccttgccttggctggactacgcgatcgcggcctggctgctcgccttcggctgcgccatcgtgatgcgcgccttccatcactggcagggcgtcgactaccggctggacgccgccttgcgctcgccgctgccgctgactgtgctgatgctgtgctgggcgctgctggccctggccgcgccgcggctggcggccggccgcgagggagcggccgcggtgaccgccagcctgctgcgcctgctcagcccggtgctgctgctgtggagcgtgctggccaacctgcagggcgagcggctgctgcccttgccgcacctgccgctgctgaacttgatggatctgtcccaactggccgtattcgccgcctgctggctgaactggaaacgcggcctgctgcgctgcgcgccgctggagccctggctgcgctggctggccggcggctggctgttcctgttcggcaacgccgtggcgctgcgcagcctgcaccattggctggacatcccttaccgcttcggcgcgctgctgcactccaccctcgcccaggcgacgctgtcgctgggctggacgctggcggcgctgggcctgatggtggccgccacccgccgcggccagcgcctgccctggctgtgcggcggcgccttgctgatgctggtggtggccaagctgttcgcggtggacctggcttcggtgggcagcatcgcccgcatcgtcagcttcatcggcgtcggcctgctgttcctgctgatcggctatctgtcgccgctgccgccgcgcgcccaccagccggaacaggataggccgtgacccgcgccgccggtcatcctgacgcgcggccatcctcgtctcgccgtctcccgcccggccggatcggttgccgcctgatccgcgagcccgctggccaaaacccacggcagaaatgagaacgcccggctcaagccgggcgttctccaaagcaaccgcgctaactcagcacgggcatttcttcatgctcttgccgccgtagcgctgctcctggcagtagcggaagaactcttcgcggctcatcacctgggcgtccgggtcgaaacggcggcggcggccgacgtacagatcgtagtcgcgctgccccaccatcaaccgggcggtctgcaccatcgcccgccatacctcagccatctacgcctccttgccggtaaaccgccggcacttccttggccgtcgcccacttcaccgccagcgacttgcggatcacatggatgccgaacaccagcatcgacaacaccaccgccatgaacatcgcggtcaacgcggcgtccacataatcattgaagatgatctgctgcatctgcgccatgcttttcgccggcgccagcagctggcccttggccgcggcggcggagaatttgtcggcatgggtcaggaagctgatcttggggctttcatggaacagcttctgccagcccgccaccagagtggccagcagcagccaggcggtgggaatggccgtcacccacacgtagcgggtcttctgcattttcaccagcaccaccgtggccagcatcagcgcgatgcccgccagcatctggttggcgatgccgaacagcggccacagcgtgttgatgccgcccagcgggtcgaccacgccctggtacaggaagtagccccaggcgcccaccgccaggccggtggccaccaggttggcgccccaggactcggtgttggccatcggcttgatgaagaagcccaacaggtcctggatcatgaagcgcagcacccgggtgccggcgtcgacggtggtgaggatgaacagcgcctcgaacaggatggcgaagtggtaccagaacgccatcatcgccttgccgcctatcgccccggacaggatgtgggccatgcccaccgccagcgtcggcgcgccgccggcccgcgacaggatggtgtgctcgccgacgtcggcggccagctgggtcagcatgtccggcgtgacgatgaagccccagccggaaatcgcctgggcggcgtcggccgcggtcttgccgatcagcgccgccgggctgttcatcgcgaagtagacgcccgggtccagcacgcaggcggcgatcagcgccatgatagcgacgaagctttccaccagcatcgcgccgtagcctatcatccgcgcctgggtttcgctctccaccagcttgggcgtggtgccggaggccaccagcgcgtggaagcccgacaccgagccgcaggcgatggtgatgaacaagaaggggaacagattgccggcgaacaccgggccgctgccgtcgatgaacttggtgaccgacggcatgtgcagctgcggcgccacgatcaggatgccgatggccaggccgacgatggtgccgatcttgaggaaggtggacaggtaatcgcgcggcgccagcagcagccataccggcagcaccgaagcgatgaagccgtagccgatcagcgtccaggcgagcgtggtgcccttcagcgtgaacagcggcgccagcgtggcgctcttggcgacgtcgccgccgtagacgatggccagcatcagcaggatgaagccaagcaccgacacctcgccgatcttgcccggccggatgaagcgggtgtacacgcccatgaacagcgcgatcggaatggtgcaggcgatggtgaaggtgccccacgggctgtcggccagcgccttgaccaccaccagcgccaataccgccagcaggatcaccatgatcatcagcacgccgatggaggcgatgacgccgggaatgtcgcccagctcctggcgtatcatctcgcccagcgacttgccgtcgcggcgcatcgacaggaacaggatcatgaagtcctgcaccgcgccggccagcatcaccccgaccagaatccacaaggtgccgggcagatagcccatctgcgcggccagcaccgggcccaccagcgggccggcgccggcgatggcggcgaagtggtggccgaacaccacccatttgttggtgggcacgtagtcgagcccgtcgttgaacttctcggccggcgtcagccggcgcgcgtccagctccagcaccttgtcggcgatgaagcggctgtagaagcgataggcgatggcataaaccgacaaggccgccaccaccagccagaccgcgttgatcgtctcgccccggttcagcgccaccatcgcgaaggccgtggcccccgccagcgccaccagcagccagacgacgcactgcttgagttgttgcataaggaagtcctgttctctctctcccccagctcacgcgatcggcagcccatctgccggtctgcatccgggtgtggttctacattattgattctgtcgtcatgataggtgaaacacaagcctgtcaggcattcaaacgcgtgttactatttttgttcgatgacgcggaatacgtacgcaatggcacaacacattctcatcgtggaagacgatgccaggctggccgagctgatcgccgcctatctgaccaagcacggctaccaggtcagcctgcacggccgcggcgacaccgcgccggcggccatcctggacacgcgtcccgatctggtggtgctggacgtgatgctgccgggcaaggaaggcttcgacgtctgccgcgacgtgcgcccgcactacggcggccgcatcctgatgatgaccgcgcgcgacgaggatgtggacgaaatcctgggcctggagctgggcgccgacgactacctggccaagccggtggagccgcgccggctgctggcgcgcatccgcgcgctgctcaggcgcagcggcgccgcccgccaggacggcggcggcgtggcggtggagaacgattgcatcgccttcggccagttcaacatcagccaggccacccgcgaggcgctattgggcgatgagcagatcgagctgaccaccgccgaattcgacctcttgtggctgctggccacccacgccggccaggtgctgtcgcgcgacgacatcatgagcgaattgcgcggcatcggcttcgacggcctcgaccgctcgatcgacgcccgcatctcgcggctgcgccgcaagctgggcgacaaccccgacgcgccggcgcggatcaagaccgtgcgcggcaaaggctatctgttctcgcgcagcgattgggaataggcatgccgtcgaagaacctgcgcagctggctcaagccatcgctggggaccttgttcgcccgctacttcctggccaccatgctggtgcagctgttgatcatcatcggcttcggcttcctggtgaccaagctgtacgagaagagcgaccaggtcagcaagctcgaattcatgaacggcaccatcgcgctgctgcgcgaccgcctgcaggcgcagccgccgcaggattgggacacccagctggcggcgatggccagccgcttcagctacccgctgaagctggtcgaccagctgccggccgaactggagcgcgacgcccgcccgcagctgcggcaaggcaagccttacctcgacggcgacaaccagctgctgtacgccaccctgcccggcagcccgcgcctgctggcgctggggccgctggacgtgcagtccagcgacagcaactggatcagcgaagacatcgaagtgctgctgatctggatgctgctgtccggcgccacgctgggcaccctgctctatttcagcctgcagcccttgtggaaagacctgctggaagtgcgccgcaccgccgaagtgttcgccgagggcgacttcagcgcccgcgcccgcaccgccaagagccggctgttcgcgccgctgccgctggccttcaacagcatggcctcgcggctggagcgccagctggagacgcgccaggcgctgtcgcacgccatcgcccacgaaatccgcaccccgatcgcccggctgcgcttcggtctgaccatgctggaggaagaagaggatgcggccgaatggcagcgctaccgcgacggcatggagcgcgatctgcaggaactggaagagctgatcagcaccagcatggagttcgccaaactcaagcgcagtgaagtgccgctgcacctggagacgatagacctgttcgactggttcgacgacctgatcgacctggtcaccccgctgaagccgcccggcctggaattgacgctggactgcgcgcgcgaagaaggcgccttcgaccgcaagctgatgtacatcgccacccgcaacctgctgctgaacgccttcaagtacgcgcagcaacaggtcaggatgcgggtctaccaccaggggtcgcaattgatcatcgaagtggacgacgacggctgcggcattccggaggccgaccgcgagaaggttttcgaacccttcctgcgcttggaccgcagccgcgaccgcgccaccggcggccacggcctgggcctgtccttcgtgcggctgatcgccgaacaccatctgggccacgccagcgccggcgccagcgagctgggcggcgcccgtttccgcatgatcattgcgcaaccggacgcgcgccagccataagtcactcactgtcacaatccgccgacaggaagccaacagaccacttgcgccgccttgcggataattcacacatctaaaacgttaaggattattgcgaatggtttcctcaagaccggcggcattgctggtgcacggcctgggtggcaccgcctacgatctgggcgcgctcggccgcacactggaagacgccgacattgtcacccactctccggtactgcccggacacggtggcagcccggaagatcttctcggcgtcggctgggaagagtgggtggaaagcattcgcagcgaataccgcgcgttgaaggccaagcacaaggtggtgcacctggccggcgtttgtctgggcggcctggtggcgctggaagtggcgcgccgggaaaagcatcaggacaagctggcgctgtacgcgccgccgatgttcctcgatggctggagcctgcccaagctgacctggctgcgccacgcggtgtactgcctgccgcagctggccaagaagatgcgcgtgccggaagtctccccgttcggcatcaagaacgcccgcatccgcaaagccatccagcagcgcttcgagcgcggcgaccgcttccactacgcctacattccgctgatgtgcatccgcgaagtggaccgcctgcgccgccagctgatgccgcgtctggccgaaatcacctgtccgacgctgatcgtccacgccgacgaggacgacatcaccagcccgcgctccgcccactacctgctgcaatacctgggcggcccggtggacttcatgccgctgtccaacagctaccacatggtgatggtggacaacgagcgcgccgaggtgctgcagcgcagcctgaagttcttcaacagccacgcccgccagcaaagcgccgagcaaccctgcggctggacggccttcgccgccgcctgacaccggccccgccgcgcgctgccgcgcaacccgcccgcccctggccggcgggcttttttttattcgccgcccgtatcgaacattcctttggaattgcaaattccattcaaaaaatcaaatcaaaaacaatagcttgcaatagtttgcaaccaagcggcgtttgaatcataatcgccgccctcgttaacacttcagcaacatttggcactggaaatgaaaaaaccactcgctgcttccgtaatggccctgagcgccctgagcgcccacgccgccgatcttggcgcctacgcattcggcactgccggcgcatcgtattccaccatcgagcgcggcgacaacctgccgagcagcgccagcgtcaactctggcaagcaaaccgacgccgcctgggaaatgggcgccggctatcgctttgaccgcagcctggccgtcgaagtcagctatgccgatttcggcaagagcgacgccaacttcaacttctgcgggttcctgtcctgcgtcaacggcaatctcagcgccgccaccaccgcggtgcgcgcgtcgctgctgaccttcctgccgatcaacgacaaggtggagctgttcggccgcctcagcctgaaccgcgtgcagaccaaggtcagcctcggcagcgacagccaggacttcaaccgcacccgcgccggcttcggtttcggcgcccactacgcgctgagcaagcaactggcgctgcgcggtgagttcgaatatctggcgggcgccatggacctgcaatacaacggctactcgctggtcaagacctccggccaaagcgcgctgaaagccggcctgagctaccagttctaagcccgctcccgattgcccgccgcccggcgggcaattttcattgcccctccgcctcatcgccgcgatgtcgcctctgctacaatctgccccaacttccttgcgagacagatcccaccatgagccacccgcatagcgacgccgtcaaatccttcctgctggatctgcaagaccgcatctgcgcggcgctggagcaggccgacggcgccggccagttcgccgaggacgcctggcggcgcgaagccggcggcggcggacgcagccgggtgctgaaagatggcgaggtattcgagcaagccggcgtcaacttctcccacgtccacggcgacgcgttaccggcttccgccaccgcgcaccggccggaactggccggccgccgcttcgaggcgatgggcgtgtcgctggtgatccacccgtccaatccgcacgtgcccaccagccacgccaatgtgcgcttcttcatcgccgaaaaagacggcgaggcgccggtgtggtggttcggcggcggcttcgacctgacgccgttctacccgcgagaagaagacgccgtgcactggcatacggtggcgcgcgacctgtgcgcgccgttcggcgccgaggtctacccgcgctacaagaaatggtgcgacgaatacttctacctgaagcacaggaacgaggcgcgcggcatcggcggcctgttcttcgacgacctcaacgactggggcttcgagcggagcttcgacttcatgcgagcggtcggcgacggcttcctgggcgcctacctgcccatcgtcgcgcggcgcaaggaccaggcctggggcgaccgcgagcgccaattccagttataccgccgcggccgctacgtcgaattcaacctggtgtgggaccgcggcacgctattcggcctgcagtcgggcggccgcaccgaatccatcctgatgtcgatgccgccgctggcgcgttgggaatacggctaccagccggaacccggcagccccgaagcgaagctctatgccgacttcctcccgccgcgcgactggctgtgacgcggccggccggttacaaagcatcaacgtacaaggccggccagatcggttatgctagccagttggcttaaacgaacaaccctgaagcccgacttccgatgcataccacctccggctccgccaccgccccgcaccgggccctggaacccgccctatggctgctgttcgcgctgatctggttcggcagcctgggttatcgcggcctgatccacgccgatgaaggccgctacgcgacgatctcgctgttcatgctgcacagcggcgactgggtcaccccgcgcctgaacgggctgttgtatttcgaaaaacccatcctgcaatactggatgggcgcgctcagcttcgccattttcggcgtcaacgagttcgccgcccgcttctggcccggcctgaccggcttcctgagcgtggccgcggtgtcgctgaccgcgcgccgtttgtggggcgcggccgccggccgccacgccgcgttggccgccggcggcatggcctggatcgtcgccaacagccacttcctgtcgctggacatgggcgtcagcttcttcctcaccgccgcgctgtgcggtttcctgctggcgcaacaagataacgccagccgcgcgcaaacccgctgggcgatgtggatcacctgggcggcgatggccggcgccacgctgagcaaaggcctgatcggcctgttgatccccggcgccacgctggtgctgtacagcctgatcaactggcaatgggcgttctggaaacggatgcactggctcagcggcctgtcgctgttcttcgctctcaccgcgccgtggttcgtgctggtttcggaacgcaacgccgatttcgcccatttcttcttcatccgcgagcacttcgagcgcttcctcaccaccgagcacaagcgcaccggcgcgccctggtatttcgtgccctacctgattctgggcctgttgccgtggaccaccttgctaccgcgcctcgtcaaggatgcctgggccgatcgcgccgccggcctgcgcatcggccgcctgctgttgatctggtgcgtgttcatcttcgccttcttcagcaagtccagctccaagctgccgtcctacatcctgccgatgttcccggcgctggcgctgatgctggcctatagcttcggccggatgcggccggcagagctgaaaaagcatatcctcctgcccgcgctgctgtggctggcgctgctggccgcctggccgttcgccggccgcttcgccaaccaggattcgccgctggacgtgatccagcccttcgcgcacttcatcgccgccggcgcggcggtgtttttgctcggctcgatttacgcctggcgcgcgctggggcaacagcggatgctggccgccatcgccgcgttgtccttcggcagcctgatcgccgtcaccttggccgccagcggccacgacagctacggccggctcaagggcagcaaggaaatcgtcaagcaaatccagccctacctgacggcggacagcgaagtctactcggtgcgctactacgatcaaaccttcccctattacgtgggcaggccggtcaaactggtggatttcgtcgatgagttcgagttcggcgagggacaggagccgcagcgctggatgccgcggctggagcagttcaccgccgcctggcgcgccgcgcccaaggcagtggcgatgctgaccgacggcaccttccaggaattgcaaaagcaaggcctgccgatgaaagtgatttatcaggacccgcggcggatggtggtggcgaagccttagccccctctcccccagcccctttccccccaggggagaggggagtacgttttggataggaatgcatgaaactgattgaattcggattgatactgttcggcgtgctgctcaacgccgccgcgcagctgtgtttgaaagccggcgtgcgccagatcggccacttcgacttttccgccgccaacgcgctgccgataggctggtcgctggccaccaacctgcccatcatcggcggcctgtcctgctacgcggtcagcgtggtggtatggatcatggcgctgtcgcgggtggaagtcagcgtggcctacccgatgctgtccatcggctacgtggtcaacgcgctgctcgcctactggatgttcggcgaagcgctggccgcgcaaaaactcatcggcatcgccgtgatcatcgtcggcgtggtgctggtcgcccgcagctgacatagaggttagacatggaatttctgcccttcacccgtcccgcgatagacgaggacaccatcgccgccgtcggcgaggtgctgcgctccggctggatcaccaccggcccgcgctgccagcaactggaagccgagctgtcggccttttgcggcggccgcccggtgcggctggtctcctccgccaccgccgcgctggagatggcgctgcaaatcgccggcgtcggccccggcgacgaagtgatcacctgcccgctgagctgggtggccaccgccaacgtgattttgaaagtcggcgccacgccggtattcgtcgacgccgacccgaccagccgcaacatcgacctggccaaggttgaagccgcgatcaccccgcgcacccgcgccatcatcccggtggacctggccggcctgccggtggaccgcgagcgcctgtacgacatcgcccgccgccatggcttgcgcgtggtggaagacgccgcccaatccatgggcgccagctggcagggcaagcgcatcggcatggaaggcgacctggtgtcgttcagcttccacgccaacaagaacatgaccagcggcgaaggcggctgcctggtgctgaacaacgccgacgaggcgcggctgttcgaaaagctgcggctgcagggcgtcacccggctgccggacggcaccatggacgtggacgtgctgggcggcaaggccaacctcaccgacatcgccgccgccatcggcctcggccaattgaaaaaactggacggcttcaacgcccgccgccgcgagctggccaagctgtattttgcgcatttcgaccgtgaactgggctgcgagctgccgccggccgacttcgagcagagcaactggcacatgttccagccgctgctgccgctggcccgcatgagcatcagccgcggcgagttcatcgcccggatgaaggccgaacagatcggcgtcggcgtgcattacccagccatgcacttgttcaccctgttccgcgccaaaggctacgccgagggcgactacccggcagccgaagacatcggcgcgcgcaccgtcactctgccgctgttcccggcgatgcgcgacgacgacgtggcgcgcgtctgcgccgccttcagccgcgtgctgcgtcctgttttaagctgagacccatgaatacaagcatccatctttccgtcgtcatcccggtctacaacgagcaggacgtgctgcaggcgctgttcgaccgcctgtacccggcgctggacgcgctgaacgtgcgctacgagatcgtgttcatcaacgacggcagccgcgacaagagcgtggccatgctgtccgagcaattcaacctgcgccccgatgtcacccgggtggtgctgttcaacggcaacttcggccagcaccgggccatcctggccggcttcgagcacagccgcggcgaacgggtggtgacgctggacgccgacctgcaaaacccgccggaagacatcgccgtgctgctggccgaaatggacaagggccacgactacgtcggctccatccgccgccaacgcaacgacagcctgtggcgccacctggccagccgggcgatgaaccgcctgcgcgagaagctcacccgcatcaagatgaccgaccagggctgcatgatgcgcgcctacagccgccgcatcatcgacaccatcaaccagtgcaacgagctgcacaccttcatcccggcgctggcctaccagttcgcgcagaaccccaccgaggtgacggtcggccacgaggagcgcttcgccggcgaatccaaatactcgctgtacagcctgatccgcctgaacttcgacctgatgaccggcttctcgctggtgccgctgcagtggttctcgctgatgggcatggccatttccgccggctccggcctgctggtggcctacatgctgctgcgccgcctgttcctgggtccggaagaaggcggcctgttcacgctgttcgccatcgccttcttcctgatcggcatcgcgctgttcggcatcggcctgctgggcgaatacatcggccgcatctaccaggaagtccgcgcccgcccgcgctacgtgatccaggcggtgctggagcaaggggacaagcgatgagccgcgccgtcgtcttcgcctaccacaatgtcggcgtgcgctgcctgaaagcgctgatcggccgcggcgtggaagtagcgctggtggtgacccaccaggacaaccccaacgaaaacatctggttccagagcgtggcgcaaaccgcgcgcgagcatggcatcccggtgatcacgccggacgatccgaacacgccggaagtggcggcgcaggttgaagcctgccgggccgacttcctgttctccttctactaccgccacatgctgaaggcgccgctgctggaggccgtcaagcgcggcgcgtacaatatgcacggctcgctgctgcccaagtaccgcggccgggtgccgatcaactgggccgtcatccacggcgaaaccgaaaccggcgccacgctgcatcaaatgaacgtgaagccggacaatggccccatcgtcgaccagatggcggtgcccatcctgcccgacgacagcgccgacgaagtgttctccaaggtgacggtggcggcggagatggtgctgtggcgcagcctgcccggtttgatggacggcagcgcgccgcatgttcagcaagacctgagcctgggcggctacttcggcggccgcaagccggaagacggccgcatcgacgcgcaggcgccggcccggcggctgcatgatttcgtgcgcgcgctgaccctgcccttccccggtgcctttgccgacacccgcgccggccgcctgctgttgtggaaaaccctgccggccggccaggccgcgccggctggagccgccgagctgtaccgcgaagacggccgcctgtggctgcgctgcgccgacggcggccgcctggcggtgctgcgcgccgaactggccggacaggcgctggacgccggcaatttcgccgcgctggccggcggcgacgcgctgcccctgggcggctaaacagaattcgactattccgcctgcgggcgaacgaggaaaacccaatgaaaaaagtactgatcctgggcgtgaacggcttcatcggccaccacctgaccaaacgcatcatcgagaccaccgactggcacatctacggcatggacatgcacgatgaccgcgtggccgaatggaaagaccacccgcgcttccacttcttcgaaggcgacatcaccatcaacaaggagtggatcgaataccacgtgaagaagtgcgacgtggtgctgccgctggtggccatcgccaccccgtccacctacgtcaacaacccgctgcgcgtgttcgaactggacttcgaggccaacctgcccatcgtccgccagtgcgtgcagtacaagaagcatctggtattcccgtccacctccgaagtctacggcatgtgccacgacgacgagttcgacccggaaaactccgaactgatctgcggcccgatcagcaagccgcgctggatctactcctgctccaagcagctgatggaccgcgtgatccacgcctacggcatgcaggaaggcctgaactacacgctgttccgcccgttcaactggatcggcggcggcctggacaacatcaacacgccgaaggaaggctccagccgcgtgatcacccagttcctgggccacatcgtgcgcggcgaaaccatcaagctggttgacggcggccaccagaagcgcgcgttcacctatgtcgacgacggcatcgccgcgctgatgaagatcatcgagaacaaggacggcaaggcttccggccagatctacaacatcggcaacccggccaacaactactcgatccgcgaactgtcgcaaatgatgctggacctggcccgcgtctacccggaataccagctcaacgccgatcaggtgaaggtggaggaaaccacctccggcgcctactacggcaagggctaccaggacgtgcagaaccgcgtgcccaagatcagcaacaccatggccgacctggactggaagccgaccgtcaccatggccgacgcgctcaaaggcatctacgactactaccgcgaccaagtcgccgccagccgcgacctgtcggagtaatatcggcgcaggccgaacttcggcccctcgcagtgccgctcattcccgcaaggggtgggcggcatttttcatgcctgaaaccctatggtgtccgctgcgcggacagatatttgcatggcggaggctgcccgccgggcaggtcagggagctgtctcgccagctccccgacccccccaggcgacccctcagcccgagaaaccccggcaaaacagcccgagcccaggtgccgccgatcaaaaaaacggcggcttaaaagcccctggcctcaggctgttttaccggcacgggcagaaggggataatggcagctcccgacaaaccattcgctacattcgatccctgcaggcaatcctgacgaaaagcatcgatagtccgccatgactacccatatagacatctgcgcctacaacccagcctggcctccccgcttccaggtggaacggctgcggatactggccgcgctgggcccgctggcctgcgcctgccggatcgaacacatcggcagcaccgcggtgcccggcctcgccgccaaacccgtcatcgacatcatgctggggctgccgaagctaaacgatctcgaaccgtatttcccagcgctggccgccgccggcttccaccgccagccgcaaatggccgccgccatgccggaccggcattatttcacccagcccgtcctgccgccgcgtcaggctcacctgcatgccgtggcgctggattcggacttttggcgcgacaagctagccttccgcgacgcgctgcgcgccgacggccatcttgcggaacactatgccgatttgaaacggcggctggcggtcacccacggcggcgaccgcgccgcctacaccgatgccaagagcggctttatcgcctccgtgttggcgatgacagccggaaaaccgcacggcaagtccgcaacacggtaaactcgccggcgattccgaatacttgaacctgccacaacaatgaaaaaactcgccctgaagatagacgtcgatacctggcgcggcacccgcgaaggcgtgccgctgctggtggacatgctcaaacgtcgccaggcgaacgccaccttcctgttcagcctgggcccggaccacaccggccgcgccatcaagcgcgtgttccgccccggcttcctgtccaaggtgtcgcgcacttcggtcgtcgaacactacggcatccgcaccctgctgtacggcaccgtgctgccgggccccgacatcggcaagcgcgaggccgcgctgctcagaagcgtgcgcgacgccggcttcgaagtgggcattcattgctgggaccacatcaagtggcaagaccatgtcgccggcgaagacgcggtgtggacccgcgccgaaatgcataaggcggcgcgccgctttcaggaaatcttcggcgagccgccgcgcacccacggcgccgccggctggcagatcaacgacgccgcgctggcttaccagcaggaactgggcatgctgtacgcgtccgacggccgcggcacccacccgttccagccggtggacgccgccggccgcaacctgggcgtgccgcagctgcccaccacgctgccgacgctggacgagctgatcggcctgaacggcctgaccaacgacaatgtccacgaacacctgctgcggctgaccgaaaccgcgccggacaccggccacgtctacacgctgcatgccgagctggaaggcatgcgtctggccgaaaccttcgagcgcctgctgcaaggctggcaggagcaaggctaccagctggtcagctgcctggacctcttcaacagcctggaccgcgccgcgctgcccaacggccgggtggcgatgggagaaatccccggccgcagcggcacgctggcgctgcaggcataagccgcgcatcgccctcaagacaaaacccgccaattggcgggttttcgcatattgggctagccactcacgcgtcttttggcgaagggccatactgattgtcgcccgcttggctatcctggcaatgaaacaccagcaaaacgatggcgccgaccacaggaatgaacaagatccacatccaccagccgctgcggccgatatcgtgcaaacggcgcatcgacacgcctatggtaggcaacactagcgccagcgaataaagattcgtcagccaccgattgtgatcgccgaacacatcatgctgaacaaccagcagcatgaggctgatgatcagattggtcagcacgaaataccaatactcctgacgtcgcgcgcggccgcggaacaccgcgtacttggacaaaactgagaaataccaatgcatcgtgattcgcttttcagattcgcggacaggcacgcatgctgatgccgcgccgcaggactccatttcaagacatgcctttgcatgctacaagcatgctaatgccatgtaaatgagcatcctatgctctcgaaccatccaggagcctcaccgtggagatcgcccaaatcgaacgcctactgctgatcaacctggcctttcattacgccatcctgatcctctggtttggcgtttttcattgcttccacggctggctgtaccggctgcacagccgctggttccgcttgtccgaaccggccttcgacctgctgaactacggcggcatcggcctctataaaatcctggttctggtgttcaacctggcgccgctcttggcgctgtggctgaccgggtcctgaaaacaaaacggcggcggtcgaatgaccgccgccgtccggcatgcgacgcgtcgcttcagccttcgcgcttgttgaggaatagcgtcaggctgagtccgccttcgccgtcgttgaccgactggatgttcttcagcgtgatgccggagggcaacaacacgctgatgccgtggccgacgccgtagcgcgacagcgttttttccagctgctttgccatgcccttggccggcagcttcgcctcgtcgtccagctcgaagccataggattcggcggcgctgcccagcgcctcttccacctgcgcgcgcggcacgaagcgctcggcggcgtcggtcagcgacttggccgccacctcctcctgctggctctccaccagcgtcaacagctcgtccttgaagcgcgcctgctccatcgggtcctcgatctcgccgctcagctgctccaccacgctagccagcatcttgctgctggacgccttgtccggcacccgcagcgccttcaggaaatcgtccagccagaacttggcctcgcggctgaggcggtccactgcgtacaccgtcgggccgtgctccaggatcagcgcgcccttgtctatcagccgcggattgatgccggaggcgtggctgatgtcgaacacgccggcgccgtcgatgatggtgaggaaatcgtcgcggatttccgacttgaacacccccagcgcgcgcatgtcgcggtcgccgtcggacaggccggagaattcgatgatcagcaggtcgccggcgctgatgttggggtgctgcgagcggccgtacaaatgcttggcgatgcgctgcgacaccgccaggaaatcgatctcgccgcggaagaactgccgcgtgtagtggtagatctcgttcaggttgagatcggtctcatggacgaactgatgtttcttgcgatcggagacgatgcccttcagatagccgtccagcagcatgcccgacaccgcctcgtcgaccgaagtggtgcgctcagacaattgcagcggctcgccgcgcgtcgggttgcccacccgatgcaccaccatgcattccaccctggattccgctatcaccatcgccatcgctccgcaaaagaatgcgcgattattgtcgccgctcgccgccttggcaaggactctatggccaggccggcgccagcgccgccgccaggaaatccaccagcagcctcaccttggggctgagctggcggttgtgcggatacagcgcccagatgccctcctccggttcggcgtaatcggccagcacctccaccagcgcgccgctggccagatgcgccgccacataatagtcaggcaactgcgccagccccatgccgcgcagcgcggcgtcggccagcacctgggcgttgttgcagcgcagcggcccgcgcacccgcaccgcctggcgcttgccgcccgcctgcagatgccagctatcctggcccagcagcaggcagtcgtggccggccaaatcctgcggccgcgccggcgcgccgcggcgcgcgagataggccggcgccgcgcaaatgtggtggcggcgctgcgacagccggcgcgccatcaaggaagaatcggtcagatgccctatccgtatcgccaggtcgtagccgtcgtgcaccaggtcctgcagttggttggacagattgaggccgacctccagctgcgggtagcgctgcatgaaatccagcagcagcggcgcgatatggctttggccgtaagccagcggcgcggtcagcttcaatttgccctgcggcgccgcctgcagccgcgacaccgcctgctcggcctcggccaacgattccagtagctggcggcagtgcgtcagatacagcccgccggcctcggtcaggctgagctggcgggtggtgcggtacagcagacgcgcgcccagccgcgcctccaactggctgacctggcggctgacctgcgccaccgagatccccagcaaccgcgccgcctgggtgaagctgccgctgtcggccaccgccacgaattcctggatgccttcccaagccgccattatttccccatggaaaaaatcatttaccgattggcccgattatgaatgccgaagagaaaaatacaatggccgattgcgcggcgcaggccgcccgacatcccgctagaaaaaaggaatcccgcatgagcccgtccgtcatccgttgcaaagccgccgtggcctgggccgccggccagcccttgagcatcgaagaaatcgaagtgcagccgccccaggccggcgaggtgcgcgtgagaatggtggccaccggcgtctgccataccgacgccttcaccctgtccggcgccgatccggaaggcatcttcccctgcgtcctcggccatgagggcggcggcatcgtcgaatcgatcggccccggcgtcagcagcgtggcggtgggcgaccacgtgatcccgctctacacgccggaatgccgcgagtgcaagttctgtctgtccggcaaaaccaatctgtgccagaagatccgcgccacccaaggcaagggcctgatgccggacggcaccacccgcttctccaagaacggccaacccatctaccactacatgggcacctccactttcagcgaatacacggtgctgccggaaatctcgctggccaaggtgaacccggccgcgccgctggaggaagtgtgcctgttgggctgcggcgtcaccaccggcatgggcgcggtggtcaataccgccaaggtcaaggccggcgacagcgtggccatcttcggcctgggtggcatcggcctgtccgccatcatcggcgcgcgcatggccggcgccggccgcatcatcggcatcgacatcaacgagggcaagttcgagctggcgaagaagctgggcgccaccgactgcgtcaaccccggtcatttcgacaagcctatccaggacgtgatcgtggagatgaccgacggcggcgtcgacttctccttcgaatgcataggcaacgtcaaggtgatgcgcgcggcgctggagtgctgccacaagggctggggcgagtcggtaatcatcggcgtggccggcgccggccaggaaatcgccacccgcccgttccagctggtcaccggccgggtgtggcgcggcagcgccttcggcggcgtgcgcggccgcaccgagctgccggaatacgtggaacgctatctgcaaggcgaattccgcctggacgacttcatcacccacaccatgccgctggagcacgtcaacgaagcgttcgagctgatgcacgagggcaagagcatccgttcggtgatccattaccgcccggccggccaggacgcggtctgatgctggagaaaatcagcgagaaccaggccttcggcggctggcaacaacagtggcggcatcgttccgccatgctggattgcgacatgcgcttcggcatctacctgccgccggcggcgcggtacggcaaggtgccgctgctgctgtggctgtccggcctcacctgcactgacgaaaacttcagccacaaggccggcgcgcaaagagtggcggcggagctgggcatcgcgctggcgatgcccgacaccagcccgcgcggcgaaggcgtggccgatgacgcggcctatgatctgggccagggcgccggcttctacctcaacgcgacgcaagcgccgtggagccgccactaccggatgtacgactacgtggccgacgagctgccggcgttgctggaagcgcagttcccgctcaacggccgccgcgccgtcgccggccactcgatgggcggccacggcgcgctgatctgcgcgctgaagcggccgcaggactacgtgtcggcgtcggccttcagcccgatctgccgcccgacggcggcgccttggggccgcaaggccttcgccgcctacctgggcgccgatgaaagccggtggaaggaatgggatgccagccatctgctggccgaacgcggctgcagcctgccgctgcgagtggacgtgggcctggccgaccccttcctcgccgaacagctgcagccggaagcgctggaactcgcggcccaggccagcggctgccggctggagctgaaccgccacgccggctacgaccacagctactacttcgtcgccagcttcatcgaggcgcagctgcgcttccacgcccgccatctgttcccgacctgagccggacggaaaacgcaaaaaagccaggcatcgcgcctggctttttttcgtatctggtggagggagaaggattcgaaccttcgaaggctgagccgccggatttacagtccggacccgttgaccgctggggtaacccctccagagcggcgcatcttatcggctcgcccccggactgtcaaccttgccggcgccgttttttgctcgctccatcccgattcacaagcccttcccgcagccgttttcctcttgcaggcgcgcccgcgccaccactcaacctgcttacggaaaaacgatgcctctctccacccatcgcccggtttgcagtctgatctcctcccgcgcccataccgacctcgccgccctgccgctgctgcgggacgcgcccgaggcgctgatcacccatctggcgcggcacaccactccggttgacggcaaacagcgcaaactgctgttcctgcgcggcgacccggagaatttcatcggcctggtgctgcggggcggcgtctatcactcgctgcaggagccggatggacacgaggtgatcatggaccgcactcagcccggggaaatggtgggcgaaagcgccttgctgcaatccggacgccgcagcagcaacgcgctgctaggcagcaacagccagctgctgctgctgcatcagcagcacttcgcgccgttgcaggactgcgcgcagctgatgaaccgagtgcagcagcaattgtgcgcgcggctgcagcgcatcagcagcttcgttgaaaccgtatgcctgtaccggctggaagcccggctggcccgccacctgctggcggaaatggagcaaagcggccgccccggccccgatggcgtgacactgccgatgccggccaaccagggcacgctggccgccatgctcaatgccagccgcccgcggctgaacgcccaactcaagcaatggcagcgcgacggcctgatccagctctcccgccagacgctgcggatactggatcccgataagctgtcccgcatcgctcgccagcttcagccatgaagacaaaggaatatttttaataaaaataacattcatttgtcaccaaagagacagttccgttatgcctgttccgccatcctgcaatcccaaacgtcataaaggatggccatcatgcaaagcttttcccaggcagcatcggaatccactgactccagcttctccatggtatggcgggaaatacacgccaaactgcagcgtcgcgcgcggcatctgtgcaagggcgatatccaccgcgccgacgagttgctgtccgacaccgcgttcaaggtgcatctctacctgcagcactcttccgcccgggtgcaaaacctggccggtttcatgttcctggcgctcaaccacgcctttctggacttgaagcggcgccagcgccgggaaatcaaggtcatcgatcccgactccgatcccgacggcgatcaggcgctgtcctgcaccggccatggccccacccccgagcagcaattatccctgcggcaacagctggccgaactggaatgcgcattcgccgcgctgaacccggaccagcagcagctgttccagctgaaattcgaagaggacctgtcctattgccagatcgccgcgcggctcggcatcaacgaagcgctggcccgcaagcgggtggaactgctgcgcaaggcgctgcgcaagcagctgaacccgggtttcacgctctccgatggcagccgtccatatcagcagaagcgccagcggcagtccgccgccaatggcccgctctgcgccccctgcgccgacgacaaggacaaagcagcatgaaatcccttctccacgccatgccgctccggctgcgccggtggcttcgcctccggcatatcctcccccgacggcccgagacaacgcccccgccgcctgccgcgcgctatgaacgccgaagccggctggaccgcctgtcccgcctcaccctgacctcttccgacgaggagggccggacatgaccgccaaactgggcagcctgatcagcggcctgaaacgcgccgtgatcgaggcgcaacgcagcgtctgccaccagcacatcgaggaattgcagcaattcttcgttccggaccaagagcagaacccggcgcaaagcttccccgagggcgcctggaccgcccgcatggtaggcatgaacgtgccgcgcgaagtgagccgcaacggcgtggtcacgatggagcaccacgaggttcaggtgccgctgatcacgctgctgccgctgaaaagcttcgccattgaaaaagtggaggtgctgaccacgctcagcctgtcgctgaccgagccgcccgacggccagccggacgcggatgacgaggccgccgacgtgctggtttccatgcgcaggcaggacgaacagaccgccgaaatcaagatcgtcatccagggtctggagcctccagccggctaccagcgcgtggtggcggcctacgagaaactgttgaacgcgcagctgcccacctaagcgccgcggcccccctcttaaaagaaaggaaacaccatggccgatacctcggacaacaacctgttgagcatggcccagcagttttccggcctgccgatgaaatcgctgatcggcggaccgctgcaggccgccgcccaggcgcagcagagcctggcgatgacgcagacccaggccatcctggaaaccggcttcatccgcctcggtgaccgcaacggcaagctgaccggctacaagccgctgactgccgtcatcgagatggcgtccagccgccccggccccgccggccaagcctcgtcggcgctgacgctcaatctgccggtgctgaccttgatgcacatcccgtcgctggccatcagctcggtggacatcgccttcgacatggaggtgaagtccagcttcacccgggaaaccgacgagcagtcggcgtccaagctggaagccggcgcagcctgggatgcccgcgccggctggggcgccttcggcgtcgagctcaagggttcggtctcctacgactcctcccactcccgcgacgacaaacagggcgtcagcaagagcaacgacgcgcgctaccacgtggaggtgaaggccgagcagcaaccggtgccggaaggactgaggctgctgctgcaggccttcggcaaaaacatggacatggcgcaggcgccggccgacgcgccggccgtcccgccgccggccggcgccaagagctgaccccgcggcgcggcggccggcgattcgccgccgcgccccttccggaggccgtcacaggatgaacgccatgctgctccatttcatctccctgccctcatcggcgcagatcgccgcctgggctgcgtccggctgcctatgcgccacgctcgtccatctgctgctgcgcaagctggcgcccgaccatgtcacccagaagcagagtgacgaggtcggcgtcatcatcgccgtggtcggcatcttctatggcctgatcatcgccgcattgctggttcgggcgatcaaccacttcgacgcctcgaccgacatcgtagagcgcgaagccgagctggccggctcgctctaccggatgagcgcccagggcctgccttcggcgcgtcaaacggtgaaggacaatctgctggcctatctggacgccgtcgtcgcccgggagtggccgcgccaacaaggcggggaagaagtgccatccggctcgcccgaactaggccggttgagccgcgcgctggccggcgtccgcccggccgaccggcgggaggctgaatatctgaatctggcgcagagccagctgaacggcctctacgccagccgccacgcgcggctgtccgaccaggcgatgaccattccctgggacatctggtcggtcagcctgatcggcgaagtgctgctgattttcttcgcctggctgatgcacgtgccgagcaagggcgtgcacttcttcctcacctgcgcgatggccgcctccatctccatcgtgctggccatcatcctgatctacgacaccccgttctacggcgacatcagcgtgtcgccggagccgtaccgcaaggtgctgcatgccatccgcgccgacagcctggacggctgagccgcgataaacgccagccccgttcacgcgccggcctccgccgcgtccatagggcaagcgcgcagcagcgccctcttcatcccattcgcgatccaggagaaatcatggcagacaacaccgcagtcaacggacagatcaccgacgccgtcacccaaaccaatgtcaaggtggtggcggaagcgccggcccaggcgatggcctcgctgtaccagctggccagccattccgccggcttggcgctgcagaactcggtccacagccagcaagcgctgaaccagatttccagcgcggtgatttccaaagcggtgtcgatgatcctgtcgatcggcgagaaaagcagctgagccgccatctctcacggagagctagatcatgcccttccccaacttcaagaacctgttcggcgccaagccgcccgccggccaggacagcgcccagcccaaaccggaccagccggccgcatccgccgccaaaaacgagccggcccagccccctggaccgccgcccgccccgccgccgcccagcccgatgcgcggcttcaccaatcagttgaaaaccgcgccggatgccagcccggacaccagcgcgctcaacagccagatcgtgcaggcggtacagctttccaacagcgaaaccgccgcctacgccggcagccagatcgcggtcgcgcccaatatgatgatcagccaggccggcggcctggtggcgcaggccggcgccaactacttcgacagcgcgagcaagctggcgctggccagcaagagcgtgctgctgaagaacatgaccgagaaattcgccaaggaggacctcaagggcgcggccgaggacgcgctgggcattctgatcaccgacctgctggtcggcaccgccgcggcggtggcggcggccgccggcgcgatggagggcgaggccgcgcacttcgccctggacaagatcgatcagagcctgagcaagtatcaacagtttctggataaaaaaactaattagcgattttattcgattttctagcgaacaaattgaaaaccaaactgaaagagagcaatttcatgtgcgaaattatcaaccacatcaaagacattgtaccattggaaactccaaccatttctttactaacattgcaggttagcgaaaggatccatgaattaatctcacttatcgaaccaaggctgccaaccaaaaccgaccaacaaatgattattgaaaaaacattctggcccaaagggcatgcctattgcatggcaaacctcatcatgccttttactggaaataatttccttccacaagaggccgatgctattgacagaacaaaagaatcgattagaaatttcatgggtgggaaaactaaaatgattgaatctaccgattcagaaaacactgctatctttccacagggcgaccaaatagagtggaaaactttctcatcagcacaaagggaccagtctatcatcagtggcatcgttgcaaaaaccacatccaaccatgcattcaatggctatctagcccatagtatctttcaaaaagatgggaaatattatgcagtcagagtaggggctggagcatacccagtctctggcctaggcagcataattgatttcatcaacacacagctcggcccacaaatatggcaatacagcgattgggcagtcgattataaaaaacatggccgcgaaaaattccaacaattctatggtaatgatgctctaaagaagaccgaaaatctcttacgatcagaaacacctgacttttatatagacctactccttgagagacaattaagacaagatgattttcatgtccacaaccacctagaaggcgaatcagaatacaatctaaaaactttaataaacctaggatggtgcaccagaacaattcaaaaaaacataatggaaaatatttaatcaaaactgccacgcaggtatggtccatcggaccataccgcgatccatttactcctccctgccattctcgctcgtttagggcggctaacaaaattcctgatgcggcgttgcgccggcttgtcgtactcaagtactgcctgcgtcggcgcgccttgcctcagccgtgaaactgatttttgttagccactcttagcccagtccccgcttccccagatcgctatttccttcacaccctctctcccccgccgtccccatcaagacagtcccgatagcgaagccagctcaacacgccatggacacacccgaccaagacgccaacgacgccgcgccgcgcggcgggttgctgcgcggcagcatcccggaattgagcaagagcccggtgcacctgctgtcggccatcgtcacgctggccgcggacaagctgtgggacgtgatgctgctggacatggcgaagacgatgccgctgcaggaaaaaacccgcttcttgctgtgcgccggcctgctgctgctgggcttcaccgccctcagcgcctcgatgacccaactctgggtggacaaggacgatccgggcatggcgctggccaagggactggcgatggggattctggccgggctgccgtactcgttcggctcaaccgagctggggctgctgttcatcggctggtccggcatcaacgagctgcagaagctggagaaataaaccgttcactcacccaaggagaacccgcaatgcgcgtcaccctcacctcccgcagccatctggccgccctgcttctcgccgcctgcggccaggcgtcggccgccgccgcgccgctgcccgcgctgggcgccgatcccaagcagaacaccgtctccggcctgtcgtccggcgccttcatggcggctcagttcagcgtcgccaactcggcccgcgtggctggcgccggcatcgtcgccggcggcccgttctactgcgccggcttgggcggcctcaatggccccgaacgcttcctcaccaccgccactacccagtgcatgcgcccgctgggcgcggccccctccggcgcggcggcctggcaggcagcacagaaattcgccggccagggcctgatcgacccggtggacaacatcaagcgccagcggctgtacatcttcaccggcgcgtcggacagcatcgtgctgcccaaggtggtggcgcaaacccgcgccttctaccagagcgccggggtgccggacgcccaggtccgatacgtggacaacgtcaacgccggccacgcgctgatcaccgccaacgccaccgacctgaaatgcccggccaacgccgcgcccaatctcaacaactgcggcttcgtccagtcgcaggacatcctgcgccagctgtacggccagttgaagccgcccgccgccaaactgtccggccaactgaaggatttcgaccagaccgagttctccaagaaagggtatacagggctgtccgacatcggccacgtttacatcccggccgcctgcgccaaggacagctgccgcgtgcatgtggccttccatggctgcacccaggaagacagccgcatcggcaaccgcttctacgccaccaccggttacaacgagatcgccgacagcaaccgcatcgtggtgctgtacccgcagatccgcaccgatcccaagcgcaacccgcagggctgctgggatttctggggctacagcagcaaagacccaagcaaccccgactactacgccaagagcgcgccgcagatgtctgccgtccgcgcgatggtggaccgcctgaacagcccccgcaaatgaaggagaaagccatggatccccaattcctgtccgcctggctccagaacgtgaatgacagctggcagcggctggctcaaaccggcctgcccgatgagcgggagtggaaaggcgcgctcaaggcttggctggacagcggccagcggctgtcggaatggcagcaggaagcgcagcggcaatggaccgaagactggcgcgcgcgcgcgggcgcggactcgttgctggccttctaccgccaatgcgacgaagtctgcaccgaattcgtccggcaaaacctgctctggcagctggagtggagcgccgggctgcggcgccaggccggcgagttggcgggctctctgctgcagacgcggggcgaaggcgacgcgctgctggcgctcaacgccgccgtccagggcggacgaaaagactgggacgaaaaactggagatgttgcagcagacgctgagcgaactgtcgccggcgctggcgcaaaacctgcagcaatggctggcgccgccgcccgcggacgcgcccgccgcctgaattcctcaaccgaaatggagaaaccgccatgaaaaccaacgcagccggcatcagcctgatcaaacaattcgagggcgtccgcctcgccgcctaccaggacatggtgggggtctggaccataggctacggccataccggtccggatgtgaaaaaaggcatggccatcacccagcaacaggcagaccagttgctggccgaggatctgcagacattcgaaaccggcgtcggcaaagccgtgaccgtgccgctgaacgaaaaccagttttccgcgctggtcagcttcagctacaacctgggtctgggaaacctgcgcagttccacgctgctgcgcctgctgaacaagggcgactacgccggcgccgccgcgcagtttccgcgctgggatcgggccggcggccaagtcgtgccgggcctgctgcgccgccgccaagccgaacaggcgctgttcctgacgcccgccccctgctgagcttcacaagccgcttcatcctccgtcctgacaacagcccccccggctctgccgcgggctgttttcgcattcaatctccggagatacgtcatgcaagacgaactgagcactctgcacgcccatgtttcccaactgctgagccagcacctgattgactgggccggcgaactgatgaacggcgcggcgggagaggacgacagccgccgccttaccaagctgcgagcgctgctggccacccgcgatgcgctggcgccgctgctgggcggcgaacagcaggatgccagtcatggctgaggcgccgctgaatcccgccctgcgccaggtggcggaacaatacctgggccggccgttgcaactgcaggaagcgcaaaccctgatggcgttccaacaaaacacgcaaagcccctctcctcagctcgcgcccatccagcaagcccggcagcagacacagcaagccatcgcccagagccagagccgcgccggcgccggcgtgcgcgacatcctggcctccatccaggccagctccagccaggcgctgcagattcaggaggccgaggagcaggcgattctcaagttgttggaaggcacgcaggacctcgccgagcttcgcccctccgcgctgcagccggcgatggcaagcctgcagccgggcagccagctggcgctcggccagatcgccgagcatctgtccaacctggctcgccaggaagtggagaagtgcttcaaccagtacttcggtccgctatccgcgcagttgcaggaagtggtgcggaagctgcaggcgcaggaggccgcgcaagcctccaccgaggcggccgcggcggaaaacgacattcacagcgacgatgccccaccgtccaagcagtagcaccgggacatggcgtccacgccggtcgccatgtccgacggtgcgcctgaccaacacaccgcactccaggagccaagcatgtccttcccgaccaccgtaaacgatcagatcaccgatgctgtcacccaggccaacgtcaaggtgctggccgagtcgccggccatggcgatgggctcgatctaccagagcatggcccactccaccggcatcctgttccagaacgccgtctcggctcagcagcagcagaatacgctggcccaggctgccgccaatatgggcgtgatgcagatttacagcatggacaccatgtccggcgccgccgccaccgagaaagtcagccaaggcggcatcgccgacaacctgaccagcctgctcaccgtgctgcagtcgttccgctgattcccgcctcatccacgataggagctagaaaatggctaacaacaccgccgtaaacgatcagatcaccgacgccgtcacccagaccaacgtcaaggtgctggccgaagcccccgccatggcgatgggctcgttgttccagaccgcctcccactccaccggcatcctgttcgaaaacgccacctcggcccagcagcagcagaacacgctgtcccaggccgccgccaacatgggcgtgatgcagatctacagcgtcgacaccatggccgatgccgccggcaccgagaaagtgtcccaggcaggcatcgccgacaacctcagcagcctgatgacggtgctgcaatccttccgccgctaagcgcgcgccgaccggagattaaggcatggcgaacaacaccgccgtaaacgatcagatcaccgacgccgtcacccaggccaacgtcaaggtgctggctgaagcccccgccatggcgatgggctcgctgttccagaccatggcacattcgactggcattctgctcgagaacgccacctcggcccagcagcagcagaacacgctgtcccaggccgccgccaacaccggcgtgatgcaggtctacagcgtggacaccatggccgacgccgccgccaccgaaaaggtgtcgcaaggcggcgtggcggacaacctgtccagcctgatgaccgtgttgcaatcgttccagcgctgattttccacactcaataaagcaggaggcattcaatggcattcccgaccgcagtcaacaaccagatcaccgacgccgtcacccaggccaatgtcaaggtgctggcagaatcgcccgcgatggcgatgggctcgatctaccagagcatggcgcactccaccagcatcctgttccagaacgccgtgtctgcgcagcagcagcagaacacgctggcccaggctgccgccaacatgggcgtaatgcagatctacagcatgaacaccatggccggcgcggccgccacggaaaaagtggcgcagggcggcatcgccgacaacctgaccagcttgctgacggtgctgcaaagcttccggaaccgctgagcgccggctttaccctgccctagcatttcgccccgctcgcggggcgctttttttgcgggcctcaccgcctggcaaacaccgccgcgatcgcttccaccgccgcccgcacccgcgccacccgctgcaaatcgggatgcagcaccagccacatgtccaccggatcggtccgctccggccacacccgctccagcccggcgtcctgatcggcgaggaagcaggacagcatggcgatgcccatgccggccagcgccgcctgccgcagggccagctgcgaattggcttgcagcgcgatgcgcgcctggtccacgctttcgccgcacagccgctgccagtggcgcggcacggtgtcgcgcgggaacatcagcagctcgtggccggcgaagccgtcgccgggcagcggccgcccgcgccgcgccaggtaatccggcgacgcatacaggctcatgtcgatggcggccagcttgcgcaccagcacctcgcccttgtccggccgcaggctgcggatggcgaaatccacctcgccggccgccacatcgctgagcgacaagccggtcagcagcgtgaactccagctccgggtgccgccgcgacagctccgccagcgccggaatgacaaaggctccggccacggtgtcggtggcggcgatgcgcaccggcccggccagttggcggtcgctgtgcgcggccttgcggctgaaggcgtcggcggcggcctccatccgttcggcgtcggccagcagcatcgcgccggattcgctcaattggtagccctgcggcatgcgcaggaacagccggctgccgatttcctcttcgaaagcctgcaagcgccgccccacggtggcttggtcgacgtccaggcgcaaggcggcggaacgcaaggtgccggcgcgcgccagcgccaggaagtaacgcgcgttgtcccaattcatgcggatcccgccccagtaagaaaatgcaaaattgcatcaccattcatcataattgtctattttttcgcatcacgttatcgcctagcatctgcctgtcttgactttgcgcggatcctcccatgccccaccgttcccacccgcaagccggcttgccggccctgctgacgctcagcgccggcatgttcatggcgatactggacaccaatatcgtcaacctggcgctgcccgagctgcagcgcggcctgcacgccagcctcagccagctcacctgggtagtagacgcttacgtgctgaccttcgccggcctgatgctcagcgccggctggctggccgaccgcctgggcgcgcgcaaggtgttcgcctggggactggggctgttcgtgctgacctcgctgctgtgcggcctggccgccaatgtggagctgctgatcggcgcccgcctgctgcagggcatggcggcggcgctattcatgcccagttcgctgggcctgctgcgccatgccttcccgcaaccggccgaacgcgcgcgcgcggtgggcgtcttcggcgggctggtggccaccgcggccgccgccgggccggtgctgggcgggctgatcctggggccattgggctggcgcggcgcgtttctggtcaatgtgccggtgggcctggccgcgctcttggccaccgcgcgcgcggtgccggcccagccgcccgcgcccggacgccgacctgatgttcccggccagctgtccggcatgctgacgctgctcttggccagctgcgcgctgatagaaggcccgcgcctggccggcggctggcagctgccggcgctgctggccgccagcgccgcctcggcctgcttgttctgcctgcttgaacgcggcaatccgcaggcgatggtgccgccgcaactgttccgccatccggctttcgccgccgccaactgggtgggcttcgccatcggtgccgcttacttcggcagcctgctgctgctcagcctgtatctgcagcaaggcttgcggatggacgcgctgcgggcgggactggcgctgctgccgctggcgctgtgcctgaccgccggcaatatcgccgccgggcggttgctgcccaggatgggcgcgcgccgccagatccgcgacggcctgctgctggccgccgccggctacctgctgctggcgctggccagccgcctcggcctgccctggctgctggcggcgatgctgccgctggcgctgggcaccgcgctggccatcgcgccgatgacggcgacagtgctggagagcgcgccgccgcaaatgggcagcaccgcgtccgccgtgctcaacgccatccgccaggccggggctctggtaggcaccgccggcgcggcgctggtcgccggccgctgcgcggacctgggccaggcgctgctgtacggcatggcgctggcggcgctgctctcgctgagcggcgcgctggcggccggacggattccccgtcccgacggcctgcgcggcctggaggcggccgcgcccagccccgtcacaagatgacgcgcctcgccgccgcctcccattgccggcgcaggccaaggcggcagccgacggcgcgttcgcgttgaaacaaccacgggtacaaacggtatagatagcgcatctttggccgcgcccttcatgacatgttgatgatggatgtcagaatagccgctacaatgttccaaataaacgcgcaatccagaaccaattgtccagatatgaaaacaatgccctcccccgacaacctgctggccttcgacgcgctggcgcgcgccggcagtttcaccgccgccgccgacctgcagggctgccacaagagcctgatcagcgcccgcgtcaaggaactggaacgcgagctgggcgcggtgctggtgctgcgcagcacgcgcaaaatggcgctgaccgaggccggcgagcggctgcggccccacgcggcgcggcttagggaaacgatggcgcaggcgcggatggcggtggaccagacccaaagcggcctggccgggccgctggcaatcagcaccacctcgtcgctggcgcaatacgtgctggggccggtattgagcgaactggccacccgctatcccgatttgaccctgtcgctgcgggtgaacaaccggctgcaagacccggtggccgatgtgctggacttctgcctgcgctcggcgcgctcgcacaaggtgcacgatgaaaacctggtggccaggctggcgggctacgccagcgaaaacctgtacgcgtcccccggctatctggcgcgccacccgccgctgcggcagccggccgacctgtcccggcaccgtttgttggtgatggagtcggaacagcgcgatgggctgctgttgaaaaagggggagcagctgttgcgccaacccatcgcggcgcagctgtatctggatcattacccgctgcgggcggagctggcgctggccagccagggcatcaccctgctcgccgactacaccgtagagcggcatctggcgcgcggcgagctggttcgagtgctgccggaatggcattgcgactactggcccatctacctggtgcatccgttccgcaccccgctcacctgcaaataccagaccttcatcgacttcgtcttgccgcgggtggcggcggcattgccggacaaccgcgctcaggcgggcagcgacggccgcgccagcagcacccggtaaaactcgacgaaggcgcgcgccgccgccggcgcgtggcggccaggcggaaacaccgcgtaaacgccgccttttggcaaggtccactgcggcaataggtggaccagcctgccctggcggatgtcctcctgcacgctgaacgaatccagcaccgacacgccggcgccggccagcagcaaggcgcgcagcgaagcggccgaatccaccttgatccgcgccttcatccgcaccgcctgctcctcgccgcccggcccggcaaacggccagctcagcggcgttttcagcagcgtcagcgccacccagtcgtgctcggccagatcctgcggccgctcgggatggccgcgcgcttgcagatacgccggcgacgccaccggcaactgagcgaattcccccagcttcagcgccctgagcgaagagtctcgcagcatgcccaggcggatggccaggtccatgccggacgccaccagatccaccatatggtcgctggcgtgcagctccagctgcaggccagggtgctggcggatgaactgggtggccgccggcgccaccgattccgccatgtggctgaccggcgcggtcagccgcagcgtgccggacagcgccgccgcgccgtggccggcctgcagcagcgcgtcgcgcaaggttgccagcgccggctgcgcgtccaggtacagcgcctgcccggcctcggtcagctttacccgccgcgtggtgcggttgaacagcgtggctcccagctgcgtctccagccgccccacctgcaggctgacgttggccttggtcatccccagccgctcggcggcggcggtgaagccgccggcttcggccaccgccacgaagatctgcagtccttccagattgttctctacgcctcgcgccatatcaactgtcaatttttcgataacaatcaattatggtttcagccgtttatcgaatcaatcgaaaagcgcatgatgcattccatcagcgctgcgacgcggcgcccccatccgatagcaaactaaggagtctcaccatgaaaatcgcactgatcggcgccagcggctatgtcggttccgccctgttgcaagaagccctgtcccgcggccaccacgtcaccgcgctggtttcccgtccggaacgcatcgaagcgcaagccaacctggccgccgccaaagtcgacgtgcaggacagcgcccagctggcggaacaactgaagggcttcgacgccgtgctcagcgccttcagcggccacgcccaggcagagcagttcgactacttcgtcaagggcatccgctccatcatcgccgcggccaaggccgcccaggctccgcgcctgctggtggtcggcggcgccggcagcctggaagtggcccccggcgtgcagctggtggacaccccggaattccctgagcaatggaaggcctcggcgctgggcgcccgcgaagcgctgaacctgctgcgcgccgaaaccgagctgaactggacgctgctgagcccgtcggcgatgctgcagccgggccaacgcaccggccagttccgcctgggcaaggaccagctgctggtcgacgccgcaggcaacagccacatctcggtggaggactacgccgtcgccatgatcgacgagctggaaaaaggcgagcatcagcgcagccgcttcaccgtcggctactgatcgcccatcaacggggaggccagacagcctccccggtttcctgcagatggcgccagcgccagttggcgccatcccggaacagcacggcggtcgcgtggcggccgttgccgctgccgtcgcccaaggcctgcgtttcgtagtaggccaccgttgcggcgtcgccatctcccatcagcagcgtcatccgctccagcgtgatttccagccccggccggctacctgccgcgccctggaagaaggcccgcagcccctgccagtccagccgcgcgccgtttggcgccaccatggcgaagccggcgtcgaaatccatcatcagcgcggccagcgcctcctcgccatgcggcccgtcgcccagccagcgcgcgatctgcgccaaagtgtcgcgaacctgcgcccataccgccaattcttcattcttcatcacgcttctcccatttgaggacgattcaataaacgcaatacctccgcattgcctatccggctgcccagccacaagggcggcaacatggccaaggcggcggccagaaaacacagatggaaggcccgcgccgccaactcccgcgccgcgggcgccgccggatcggcgatgccttgcccggcaagcagcagattcagcaacacgcaagccaacgccatgccgacgcagaagctcacctggcggttgatgttccacaaggcgctggcctcgcccatccgcgccggcgccactcccaggaaggccgtgctctggctggcgctgctgcacaaggtgccgcccaggcccatcaacgcgtagctgccggccagccaaggcagttgcccggagcggtctatcgccagcaagctcaggaaaccgatgccctgcgccagcgcgccggccatcagcagcggtctcggccccaggcggcggtaaccgcgcccggtcagcgcgatcgcggcgaacgcgcccaacgaccacggcagcatcaacagcccggccgcggaagccgacacgcccagcacctgctgcagatacagcatcgccaccaggctgacgcccatgaaggcgcccggcaccagcagatacatcagcatcgacatccgcagcagcggatcgcgcagcaattccagccgcaggatgggccgcggatgccggcggctatgccgcgcgtaagccgcgcccaacgccaggcccgcagccagcagcgcgccgccgcgcgcccaggtggacggctgcgccagatcgcccagcccttgcaaggccagcaacaatgccaggctgcccagcagcaggccgagccaatccaggccggcggccggctccggctcgcgctcgtcccgcagccagcgcagcgccagcaccagcggcacgatggccagcggcaggttgagccagaaaatccagcgccagcccaacgcgtccagcgccagcccgcccagcgtcggcgacaaggccggcgccagctggcccaccagcaaaatcatcgcggtcaggcccggccgctccgccggccggtacaagcgataggtcatggtctggcccagcggaatcagcaagccgccgcccaagccctgcagcgcgcgccaggcgatcagcgcgccgagcgagccggcctgcgccgcgccggccgagcccgccatgaacagcagcagcgaggcgacgaacacccgcttgccgccccagcgcgccgccagccagttgcccagcggaatcaccgcggtcagccccagaatgtaggcggtgcccacccaggccagctccgccacatcgcgatgaaaggtgcgggcgatgtcgggaaaggcgacattgccgacgaaaagattggccagatcgatgaaaaaccccaacaggtacactgcggccacgcgtttgcgatactccatgcatccaacctccttgcttgacggaggccagcttagtctcgcccgatggccggaaaaaccactggcaatcgattaaactgtcaaaataattttgacaataaggtccttctggacatgagcctgcaacgcttccgcatcttcgccgccatcgtggaaagcggctcgctgaccgccgccgccgaggcgctgggccacagcaaggcggtggtcagcttcaacctgaaacagctggaggccgagctgggcgtggcgctgctgacccgcagcacgcgccggctgcagttgaccgaaaccggccggcgcttctaccaggactgcctgcatgtgctgcgcatggcgcagacggcgatggacgatgcgcgccgcggccacggcggcctgcagggcacgctgagcgtgagcaccacaccggaatacggccgccgccgggtgataccggcgctggcggccttctccctgctgcatccgcggctggcggtgcggctggagtcgtcgtcgcggcatgccgacctgatttcgcagcaagtggacgtggcgatccggctgggctcgctgagcgactccagctaccgcgcgcggctgctggaggaattcgacatctggccggtggcctcgcccggctatctggcgcagccggacaagcaagtggaaagcgtggacgggctcgcccgcgccgactggctggcgcacagccggctggcggcgccgctgcgctggaaactgacgggaaaagacggggaagcgatgctggacgcgggcgacgcgccgcgcatcgtcgccgacacctcgggcgcattgctggacttcgcgcgccagggctgcggcgtggcgctgctgccggactggcaggtaacagacgatgtggccgccggtgcgctggcgcgcctgctgccggattgggcatttccacgccaaggcgtgtacgcggtctacccggacacccgccacctgccggaaaaagtgcgcgccttcatcgactttttcgccgactacctcgcgccgcggcaaggggaaggctgagccttcccccttcctgcaaccggtcatggttgtgaatccgctacgcggataatgcttttcatagccgggcctgccacccggcggcaggcttgaaggggccggtggcgcacccaatacgcggtttctgaccagccaagcctaaaaaacgggcagaagatcgttagcagattcttacagcttgaagcgcgacaccacgccctccagcgactgcgacaagcgctccagatcggccaccacctggccggcgcggccgatttcggcgtcagattgcagcgcctgcgacgacatctgctcggcggtgcgcgccatgtcttcggtggccttggactgctcgctggcggcgtcgcggatttccgccgcctggcgcaccaccagctgcatgctggaacggatctcggcgatctggcgctgcgcttcttcggccagctccacgccgccctgcaccgcgccataagtcttcgccacccgctcgcgcgcctggcccgagccctgctgcatgccgccgaccatgtcgtcgatctccaccgtggcctggctggtgcgctcggcgagcttcctcacctcgtccgccaccaccgcgaagccgcggccctgctcgccggctcgcgccgcctcgatcgccgcgttcaacgccagcagattggtctggtcggcgatgtccttgatcacgccggcgatgctgcccacctgggcggagcggcgctccagctcttccatcaccgtcttcacctcgtccatcgacgaagcgacagagccgatctcgacgctgaccttgcccaccgcctgcgcgctctgttccgacagcgcgccggcctgctgcaccgcctcggcggtgccgtggcaattgccggcgatgtggctgacgctgaccgacagctgctcgatggtggcggcggtggtttcgctgaggtcggcgttgtggcgcgagccggcggacaggcgctcggtcatccgcgccagctcgccggcgctgcggtgcagctggccgctttgttcgcgcacctgcaggaacatcgcgcgcagctgctccatgaactggttgaacgccgccgcaacctggccggtttcatcgcggctgtcggccggcaggcgcatggtcaggtcgccgtggccggagctgagcgcgcgcatcgcgtcgcgcagttgcaccagcggccggctgatgaagccggacacctgccagatcaccagcagcgacagcagcagcaccaccgcgtcaatcgccgccacccaccagatggtgcgcgtcaccgcgccgtagacttcgccggcgtccatttccaccaccacgaaccagtcggcgttgggcatatagctggaggcggcgatggtcgggccattggggccgtcgaaatgcgccaggttgaagccggacttgttcagcagctgcggcgcgatcgccgacaggccaggcagctctgccagcatggttttcttctgcatcgccgccggatcgcggtgcagccgcacctggccggcggcgtccaccacgtagacctggccgcgctcgcccaccgccatcttgcgcacgcgctcggccatctgggtgacgtcgaagcctaatgccgccaccgcgcggtggccggcctggcccttgttggccagcacgttgacgaacatcatcacctgctgcttgccggtttccgagcccagcgtgaactggctgtcgcggccggaggccaggaagtcggccagccacttgtcgttgcccttggggtcggccttgaccgtggcgtggtcgatgtagatgttgagcgtggcttcggaagtccaggagatgatggacgcgcccgaggtctgcatcagcgccttggcgtagcgctgccaggggccgacgccggattcgggctcgccggccgcggtccagtccagcagataggtgttggccgccaactggcgggtctggctcaagggcagcgcgatggaggcgtccagctcgttgcgtatgccctccaccgtcgccttcagctcatgctgctccaggcgctcggtcagcgccgcctggaacatgcgggtggagaccgcgccggcgatggccagcgcgatgagcaggatcagcgcgacgctgaccaggattttctgtttgaccgaccagttcttgaacatgcttgcggcttacccgaaaaaggactgaaaccgtccggcgccaggcccggacacaacagcggccggccgcggcccttgggtttgccacccaagcggaccgcgccagccggaagaatgcggcgctgcgccgcatcggcaggcacagccagcttgaagccacgcctgcggaatatcggcggcaattgtaacaagcccgcctatgttcaatatgaatatttgcggcaaaacttcttcagattgagggattggcgcaacaccgcctcaagcgcggcgcgccggctcgctgtcgtgcaggaagcgggtgtagatgtcgcgtggcggctgcaggccgcattcggccagcacgcggcccgccgcgccgcgatggtagccgccgtgggtgatcacctgcagcagcatctccgcccggctcatccggccatggccgccatcggtgaaggtgaaatcgatggcctcggccagctcggccgcgctcagcgaggatgagtattccacataccaggcatcggtttcgcgcaccgcggccagcagcgccgccaattcgggcgtgtccggggtgttggtggcggcgtagccgtgcggctgccgcgtcaggttgccgcggaagatccggtccacaacgtggatgtggttgaggatgcggatggcgagatggcgcttgtccggatgggccgcgccatccagccgcgccgcctccgcatgcagctcttcatcggcccaggccttgtaacggaacaaggagggaaacagctcggggaaactcatcttgcggcctttcgcgccgggcggcgctggggtgggacaagtttcccattgtctcacagcggactttccgatgtcatcgcgcgccgtaggcgatcaggaacacctccaccgccgacgccacccaggccggccggctctccttgggcgccagttgatccaccaggccggtgatcagcgccacctggcattcggcatgcaccaggccgtggaaatgcatcgccgcggtccacggcgaggcttcgcgcaggcggccggcctgcatctcggcggccatgaactcggccagattgccccagccgaccttcggcccgttttcataaaacaacagccccacctcggagcggctgccgctgcccatcacgatggcgcgcagcgcgcgcaattcaggactgaacagattgtccaggtaggcctcgccgaaatcctgcagcaccgccgccagatcgccgccgggcaccagcttgacgtagaccttggacatttccccggccaggcaagccatcacctccaggaacagctcttccttggacgaaaaatagttgtacagcgtggccttggagccgccggcccgggtggagatttccgacatcgacgccgcctcgtagccgcgctccagaaacacctcggtcgccgcggcgatgatcgcctgacgcttgctttcgctttttgtgcgcatacccaccttaatactgaaccgtacggttcaattttccttgacatcgccgctagcttggaaatataactataccgtaccgtacagttaaaaccaacagcaaacagatcgagaccatgagaaccgctaaatttttcccgccgcggccgctgtccatcggcctattggccgcgctggcgctgctgggcggctgcgccgccgtgccggacatgggtccggcgccgcagatcaaaccgctgcaaccataccagaatacgcaaagcctgccttctgaacagggtcaatgggccgctggccaatggtggcgcaaatacggcgatgcgcagctgaacaagctgatggacgaagcgctgagccaggcgcccgacctcgccgccgcccgcgcccgcgtcgagcgcgccgagggcctggcgcagcaggccggcgccgcgcggctgcccagcgcggacctgaacgcggcgatcaaccgcgacaagcaaagctacaacaacggcatgccggcgccgataggcttcaacagcagcggccgcgccacgctggacttcagctacgagctggacttctggggcaagaaccgcgcgtcggtcgccgccgccacttccgagctgaccgcggcccgcgccgactccgcccaggcgcggctgatgctgaccacctcgctggccgccggctacgccgagctggcgcggctgttcgccgagcgcgacgccgccgcccaggcgttggacgtgcgcagccacaccgcgcagctgatgagcgaacgccagcgccagggcatggaaacgctgggcagcgcgcgccaggcagagtcgcgcgaggcggccgcccgcgccgacctggccgccgccgacgaaaacatcgtcctgcagcgccatagcctggcggcgctgatcggcgccgggccggaccgcggcctggccatcgcccgccccgccgccggcttgtttcgcgaacagcggctccccgacacgctggcggcggaactgctgggccgccgaccggatctggcggccgcccgtctccgcgccgaagccgcggccaagcgcatcgatgccgccgaggcccagttctaccccaacgtcaatctcaccgccttcgtcggcgcccagtctttgggactgggactgttcgacaaggccggttccggcatagccggcgtcggcccggcgatcaatctgcctatcttccgcggcggccagttgcagggccaataccgcgccgcgcgcggcgactacgacgccgccgtcgccagctacgacgccgcgctgagccaggccttgcgcgaaaccgccgacgccgtggccagccaggccgcgctcacgccgcagctggagcagcgccggctggcgctgcaaaccgccgacgaagcctaccgcgtcagccagaaccgctatcagggcgggctggccaactacctggacgtgctgaacgccgaagacggcgtcatcgccagccgccgcagcctggccgcgctggacgcgcgccgcttcgcgctggacgtcgccctgatcaaagccctgggcggcggctaccaacaaaccgaaccacaggccgcccgctgaggccgccggcaatcccacacaaggaatccccatcatgagcgaaaacgtacaagccctgccggcctccgaagcgcccgctgccgcaggccgtcccctgcaacgcaagaagctgttcacgctgctgttcggcgcggtggccgccgccgccgtcggctacggcggctactggacgctggtcggctcccgccatgtcagcaccgacaacgcctatgtcgccgccgagatcgcccaagtgacgcccgaagtggccggcaccatccagcaggtgaaggtggtcgacacccagccggtgaaagccggcgacgtgctggtggtgctgaacgacagcgacgccaagctggcgctggcccaggccgaagccgacctcgcccgcgccgagcgccgggtgaagggctacttcgccaatgacgagggcctgagcgcccaggcccaggcgcgcagcgccgacgaggcccgctccgccgcgcagctggcctcggcccgcgccgacctggagcgcgcgaaactcgacctgcagcgccgccaggcgctggcgaaaagcggctcggtgtccggcgaggaactgagcaacgcgcaaaacgcctacgccaccgccgcggccagcctgaaagccgccgaagccgccagccagcaaagcgcggccaactaccgcgccgccgtcggcagcctgaaagccaaccagacgctgaccgccgacaccacggtggcagacaacccggaagtgacgctggcgcgcgccaagcgcgaccaggcacggctggacctggcgcgcacggtgatccgcgcccaggtggacggcgtggtggccaagcgccaggcccaggtggggcagcgggtgcagtccggcacgccgctgatgtcgttggtgccgctgcagaacgcccacgtcgacgccaatttcaaggaagtgcagctgaacaaggtgcgtgtcggccaaccggtggagctgaccgccgacctctacggcggcaaggtggtctaccacggcaaggtggccggcctgtccggcggctccggcgccgccttcgcgatgattccggcgcagaacgccaccggcaactggatcaaggtggtgcagcggctgccggtgcgcgtcgcgctggacccggccgagctgaaggcccatccgctgcaggtgggcttgtcgatggaagccaccatagacgtcagcgagtgaggcccccatgtctagcgcgaatcccgccgtccagcagccgctgaccggcaatatgctgtggctggcggcgctggtgctggccgccgccaacttcatggtggtgctggacaccaccatcgccaacgtgtcggtgccgaatatcgccggcggcctggcggtgtcgtccagccagggcacctatgtgatcacctcctacgcggtggccgaggccatcatcgtgccgctgaccggctggctggcggcgcgcctcggcaccgtgcggctgttcgtcggctcgatgctgctgttcggcctgttctccatgctgtgcggcctggccggctcgctggagacgctggtgctgttccgcgtgctgcaaggcctggccggcggcccgctgatgccgatgtcgcagacgctgctgctgcagatcttccccaagcacaaggccggcgcggcgataggcctgtggagcatgaccacgctggtggcgcccatcatgggccccatcctcggcggcacgctgtgcgaccaggccagctggccgtggatcttctacatcaacgtgccgatcgcgctgggttgcggctttctgggctggagcctgctcaagcgctaccagagccaggtgctcaagctgcggatagacgtggtgggcctggcgctgctgatggtgtgggtggcttcgctgcagctgatgctggacaagggcaaggagctggattggttcggctcccccatcatcgtcggcctggccatcgccgcgctggtcggcttcgccgccttcctgatctgggagctgaccgaggcgcagcccatcgtggacctcagggtgttccgccaccgcggcttctgggccagcgtgctgaccatctccctggccttcggctccttcttcggcgccacggtgctgacgccgcagtggctgcaggcctatatgggctacaccgccacccaggccggctacgccaccgcgatgagcggcatccttgcggtgatggtggcgccggtcgccgccaagctgtccaccaagctcgacccgcgcaagctggtgttctgcggcgtgatgtggctgggctgcgtcacgctgtaccgcagtttctccaccaccgacatgggtttctggcaggtggcgctgccgctgctgttccagggcctgggcatgccgttcttcttcgtgccgctgaccggcctggcgctggccagcgtcgagccggcggaagtggcctcggcggccggcctgatgagcttcatgcgcacgctgtccggcgccttcgccacctcgctggtgaccaccgcctgggacgacaaggccaattacaaccatgccgagctggtcggcatggtggacggcggcggcgacgcgctgcgcgcgctgaccggcagcggcctgtccgacagcacggcctggggcaccatcgagcaagcgctgcaggcgcaaagcatcatgctgtccaccaaccagatcttctggctggccggcctgtccttcatcgtcgccgcctgcgcgatctggctggcgccccggcccagccgcgtcgccgacaccagccaggcccactgagccatcccgttttcaccagcttgccccgcgcccttgtggccggggctttttttcgtcctgtatcgaaggccagtctttacatacggccaccatcttgtaacagacttttacatatacagcgtgctatcaatatgccgacacaataactcatgccggcgctgccggcggcgcctccgcctttcattcaacgcagacaggaaacccccagcaatgaaacattcgatccagcggctggcgctcgccgccgccgccgcgctcgcctgccaggccgccgccgccgcgccgctgcagcccatccgccacgacgccttcgcccaggcctgccaggcgctatggggcagcgcaaacgcccgcagccattgggtgaaggacgacggccagggcggcctcgcctacgcgccgctgaacggcgacggcgaccgcatcatggacttctccagcgccggctacatgggcggcggcgtggcgctgccggccgcgccggtgaaggcgacggtgaagcccagcggcaacgcggccggcgacctcgccaacatccaggccgccatcgccaaggtggccgccttgccggcggtgaacggcgtgcgcggcgcggtgctgctggcgtccggcaccttcctgctgaatgggccgattcaactgaatcaggatggggtggtgctgcgcggcagcggctccggcgccggcggcaccgtgctgaaggcgcaaggcagcggccacgcgatgctgagcctgggcggcgccagcgcccgcctgacgccggtcggttccaccgccatcatcagcgacagctatgtgccgtccggcagccgcgtcatccacgtggccagcgcctccggcttccagcccggcgacgcggtgatggtgcgccgccgcgccagcgccgaatggatccacttcatggacatggaccagctggtccgcgatggccaggcccagacctggatcaacgccggcaacaacaacgaaatctggctgcgcaccgtcgccgccgtcagcggcaaccagctgacgctggacatcccgctgtccgactccttcgacagcggctacctgggaacgaacggcggcagcgtgcagaaataccaggccagcggcatcgccgcccagatcggcgccgagcacctggcgctggaaggcctgcccaacggcagcggcaccgactacggcgtcgccaacctggacaatctggccgacggctggctcaacgacatccaggcgcacaacttcaccaacggcgtggtggtcggcaagcaggcgcgccgcctcaccctggaaagcatcgcgctgaatcacgaccacaacaacgtcgattgcaagggcgccaaggccttcgaattcagcatcgccggcagccaagtgctggtggaccgcagcgcgtccaccggcagcaagaagtcgttctactacgccactcaggcccaggccggcggccccaacgtgctgctgcacttcagcggccgcgccgaagcctgcggcaatatcgaaccgcaccagcgctgggccaccggcctgttggtggacaacgccgacatcagcggcgcgatcgcgctgggcaaccgcggcgccgatggcagcggccacggctggagcatgggctggggcgtggcgtggaatgccaaggccgaccagctggccatcgccgcgccgcccggcgccaccaactgggcgatcggcagcagcggcgcgctgacgcccaatgtgccggacgcccagggcgtgccggtgccgcccaagctggggacagtcgactcggtcaacgtccgcgtcggtccggacagcctgtacctgatgcagctgtgccagcggctggggccgcaggcggtgaagaacatcggctattgatggatgtttgaaatgaaatgataagaggcccaaacgggcctctttcgcgttcaaaacggcgcgcgcctcagtgcaagtctccgttttcccacatctgcgccagccgctccggccagaacagcttgggcaactgcagcaccgccggcgtcgacggatgggtcagaatcggataccagcgcccggtgatgcgcgcattcggcgcgtaacggcggaagaacatcgcggtggacgcctcgacgggacgctcggaccaggcctgcggcaaggtcatgctcaggcagcggcccatttcgtccgtcaccagctgggccagccgcgcccgctcctcgtccgcctgctcagtgttcttcaactggtacaaatcgctggccaacaccgccagcgcttgcggctggcgatcgaaatacgggtcgccggaatgcagcagcaacagcgggtgatcatagccgccaacctcgaacagcaagcggttggcctgcaccagcgcggcccagcgcacgctgccgtggttgaacagcagcctctgctggcgatagatttcctgcaggccgtcctctgccgcgatgaaggttggcggatgggtgtgcagcaggcgcccgcacacgccgtgccaccatctgggacgcttggcgaaattgcgccgggtttgcgccagcagctcgcccatcgaggtatcgacaaaaaactccggcttattcatcgcgcgtcagcacttccagcaactcgatctcgaacaccagattggaatgggccggaatgcggtcgccgatctggcgctcgccataggccaggtgcgccggcacccacagcttgcgcttgccgcccactctcatgcccatcatcccctggtcccagcccttgatcacgcggccggtgccgatcacgcactggaacggccggcccttgtcgatggaggagtcgaactgggtcccatcctccagccagccggtgtaatgggtggtgatcagagcgccgcgcacggcttccttgccctcgcccaccaccaggtcttccatcttcaattcttcgctcattgctcttcatccaccaacgccgcgcgggcgcaaaccgctattgtactccgcgcggcgagcgatggatcaggcgtcccaggccggggcgaaatccggatcggcgatgcggccgccgtcttccagcttggcgatgcgcgccatgtcgtcctcgtccaggcgcagcgtcagcgcgtccagattggccgccagattggcgcgtttggtcgacgacggaatcaccgcgatgtcctgccgcagctgccaggccaaggccacctgcgccgccgtcgcgccatgcttctggccgatggcttgcagaaccggatcgctgacaacgcgaccgtaggccagcggcatgtagccggtcagcgcgatgccgtgctcgcggcaaaaatcgcgcaccttcaggttttgcaggtagggatgcacttccagctggtgggtgccgatggcgtcggcgccgacggcgtccatcgcctgcttcaggtgggcgatggtgaagttggacacgccgatgtcgcgggtcaggcccagttgcttcgcctccgccagctgttccatgtacaccgccaccggcacttcgtccttgggcgacggccaatggatcagcgccatgtccacgctgtccaggcccagcttgtccaggctctcgcgcaggctggggatcagcaggccggggccgaacttgtcggtccagatcttggtggtgacgtagagttcgccgcgcggcacgccgcccttggcgatggcgcggccgacgtcggcctcgttgcggtagatctgcgcggtgtcgatgtggcggtagcccagctccaggcccatcgccaccgattcttcggcttgttgatccttcaggcggaaggtgcccacgcccagtttcggcattttcatcatgcgtttccttttgcgatgtgaggccgagcggcgcgcgcccggcgagagaatcagatgcggccggcggcaaccgtcatgcccgaagcatggccggcatccagcctacccgaccaggcggtcaacagccaggcccccagcacgatcaatgcgcctatccaaggcgtggccatcagccccaggctggccaccacgtggccgcccagccaggcgccgccggctatgccgacattgaaagccgcgatattgaggccggaggccacgtccaccgcctgcggcacccgcgccctggcctgcgacaccacgtacagctgcagtccggccacgttgccgaaggccaccgcgccccaggccagcaccgtcagcgccaccagccacttggagccggcggtgaaggtcagggccagcagcaccagcgccaagcccgcgaaaatgatcttcagcgcggccaccggccccttgcggtcggccaggcggccgccccagatattgccgatggctaccgacacgccgtacagcagcatgatcagcgccaccgcgcccggcgcgaagccgctcacagtctccagcatcggcgcaaggaaagtgaaagcggtgaaggagccgccgtagcccagcgccgtcatcgcgtacaccagcagcagccgcggctgcgccagcaccgccagctggctggacagcgaagccggcgccggcttgggcagattggacggcaccagcgccaggctgcccagcagcgccacaacacccagcagcgacaccgccagaaaggtggcctgccagccgaaatgctggccgatgaaggtgcccagcggcacgccggtcaccagcgccacggtcaggccggagaacatcagcgcgatggcgctggcgcccttgtccttgggcaccaggccggtggccagcgtcgaacctatcgagaagaacacgccgtgcgccaggccggtcagcagccgggcggcaatcagcgcctggtagcccggcgcctgccaggccaccagattgccgatggtgaacaaggccatcagcccgatcaacagccatttgcgcggcaggcggccggtcagcgcggtcagcagcggcgcgccgacggccacgcccagcgcgtacaggctgaccaacaggccggccgacggcagcgacacgccgaggctggcggagatggtgggaatcaggccgacgatgacgaattccgtcgtgccgatggcgaaggcgctgagcgtcagcgcccaaagtgcgagaggcatgatgcgctccggttgggaatcaggacgccgattgtccgcgcttgccttccgcggaaaaatgggctgtagtgacaaggtcttttgcgtaaaaattgataatgctgagcacggaaagcctgattacctttatcgccatcatggattgcggctcgttcaccgccgccgccgagcaactgggcgtcaccgcgtccaatgtcagccgcagcctggcgcagctggaaaagcagctgggcgtgcgcctgctcacccgcaccacgcggcggctggagctgaccgaggaaggcgcctggctgctggagcgcgcccgcgccatcgcgcaaagcctggacgacgccgaacagcagctgcaggccgcggcggcgcgcccgtccggcctggtgcgcgtcaacgccgccatcccggtgctgaatcatctgctggcgccgctgctggccggtttccaggcgcgctatcccgacatccggctggagctgaccggcgccgaagccgtggtggatttgatagaggaacgcgcggacctggcgatacgcgtcggcccgctggccgactcgacgctgaacgcgcggctgctgtgcgaaagcccgctgcgcatcgtcgccgcgcccggctatctgcggcaacgcggccatccccgaagcgcggcggacttgccgggccaccgcctgctcggcttcaccagcccggccacgctgaacctgtggccgctgggcgcgcgcggcctgaaagtgtcgccgtcgccggccgcctccagcggcgccacgctgcgcgcgctggcgctgcaaggctgcggcatcgcctgcctggcggactttctggtggggccggacatcgccgccggccgcttggcggacatccgcttgccggaacagcaggactggaaacagccgatctgggcggtgttctacaaacagggccggccgcaaccgcgcgtcgcctgcctggtggactacctggcggcggcgctggcggagccggccggcggctccccgcccgcaagccagcacgccgccgcggccgccaacccttcccccgcccatccaacatgaaacggctgcctcccctgttgctggcctgttgggccgtcagcgccactgcagcctcggtggtggtgggcgtcggcgaccaggcgtttccgccatacaagctgggcaaccagacgctggacccgcgccgcccgggcctgtcggtggagctggttcgcctcgccagccaaagctgcggactgcaggccgatttccggctactgcccggcgcccggctgttgaaggaattggaaaacggcaatgtcgacgcggtgatgatgctttcctacacgcctgaacgcgcccgcttcgccgtctatccgctgcgcagcgggctgccggacgaagcccgccggctagcgacgctcagctacgtgctgtacgcgctcaagggcagccggctggcctgggatggccatcatctgtccaatcaaaaacgcgccatcggcaccaacgccggctggtccatcaacctggatctgcagcgcatggggattccggccgaggccgccaacagcgtcgaacagaatttcgacaagctgctcagccgccatatcgacggctacgcggtgcacgaatcgctgggcgacgcgtacctggcgcgccatccggcgctgccggcgcgcaagctgtcgccgcctatcagcaccaagccctacttcctgccgttttcgcgccgctacgccgccacgcagcccaggcagatgcagtgcgtctggcaagccatcgccgccaatcgcgacgaattgctgcggcagcgcatcgccgcttatctggacgacaagcgctgaaacggggcgatattcggtcagcggagcgataacactgcccgccgggatgaaaaacacgccggcgcgacggcgccgcgggcgatagcgaacctgggaaaattagaacaaacaacagcaaacgccgctcgcaggccagcgaacagccaaacgccaacaggcggatatgaaggatatgaggcggaatttacctgcgctgcttaagctgcaccaacgccatcacgatcagcaacagcagcaggatggctgccacgccaataggcgccagcccccaccaaacactgttgccggaaagatacgccaccagcgcaatcaacaagctcaacaagatgaaaatcttcattcgcatacactacctggggccccgccatgacagtcgaacgacgcctcgacacagcctggcccgtgctggaaaaacaaaaatagttacacttattcaatatgttacatcagaaaccagccatcgttccctctatggcggcattcaataataggtacttaaaatagtatgcattgtgaaatatgatatcacgccaaacctactgacggctgatgccatccgcgcgcttgcgccgacacgcatagccatcattctgccagtcgccccaccccgcatgctacagacggctcatctcccgcgcggctccaccagccgtcattgccgctaagctctctcccctgcactacaataccaaaagcataaatctccctatctttgtccgcgggaacttcgccggagaacgcacttcctagcaataagcgcgccatcagcagcaccgtatcgccataccgcatccatcccggaatccactggagaaacgccatgcaattgaacggaaaagtcgccctgatcaccggagccgccagcggcataggcaaggaaatcgccattgtgtacgccaaggccggcgcggcggtggccatcgccgacatcaatctggacgccgcccgcaagaccgccgacgaaatcgcctccgccggcggcaaggcaatcggcgtggcgatggacgtcaccaacgaggacgcggtcaaccagggcacccagcaggtggtggacgccttcggccggctggacatcctggtgtccaacgccggcatccagatcgtcaatcccatcgtcaactacagcttcgccgactggaaaaagatgcaggccatccacgtggacggcgccttcctcaccaccaaggccgcgctgcagcacatgtacaaggacaagcaaggcggcgtggtgatctacatgggatcggtgcactcgcacgaggcctcgccgctgaaatcggcctacgtcgccgccaagcacgcgctcttgggcctggcccgggtgctggccaaggaaggcgcgccctacaatgtgcgctcgcacgtgatctgccccggcttcgtgcgcacgccgctggtggacaagcagattccggaacaggcgaaggagctgggcatcagcgaggacgaagtcgtcaagcgcgtgatgctgggcaataccgtcgacggcgtgttcaccacggtggacgatgtggcgcagaccgcgctgttcctggccgccttccccagcgccgcgctgaccggacaatctttcgtggtcagccacggctggttcatgcaataaggggccggcatggcgcaaaccaagctcaacccggcctgccacgtcgacgccggcatccaccacagccccgccctgcccgccggccaccgctaccaggtggtggcgctggtgctgcaaggcggcggcgcgctgggcgcttatcaggccggcgtctaccaggggctggccgaggcgaacctgcaccccaactgggtggccggcatctccatcggcgccctcaacgccgccatcatcgccggcaacccgcccgaaacgcgcgccgacaagctggagcagttctggaacaccatcagccgccagccgctgctgccgcccagcccgcacaatctgctggacctggggcagacgctgccgccgtcgctgcagggcctgttcaacggctgggaagcctggcgcgcgctgaccgaaggccagaacggcttcttcgtgccgcgcaagctggtcggcgccggcagcctgctgcgccccggcaacgccagtttctacgacacctcgccgctgaagagcacgctggaaaagctggtggatttcgaccgcctcaacgacagcggcgaaatgcgggtgtcggtgggcgcggtgaacgtgagaagcggcaacttcgtctacttcgacaacacccgcgaaaggctgcgcgccgagcacttcatggcctccggcgcgctgccgccgggctttccagcggtggagatagacggcgagcactactgggacggcggcatggtgtccaacaccccgctgcagcaggtgctgacggcccagccgcgcaagcattcgctggtgttccaggtggacctgtggaacgcgcgcggcgcgctgccggaagacttgtccaaggtggcgctgcggcagaaggacatccagttctccagccgcacccggatgatcaccggctatatgcaggaagcccagcagtttcgccagatgctgcgcgaagtgctggaactggtgccggaggagaagcggcaggcgccggcctaccgacgcgccgcccagcaagcctgcgaccggctgttcaacgtcatccacctgatctatcaggacaaaccctgcgaaggccactacaaggactaccagttcagcgccagcaccatgcgcgaacactggcagagcgggctgtccgatatccgccgcagcctcagccaccccgactggctgcagatgccgccgccggagcggcccttcaccacccacgacgtgcaccggctccaccaggcctaaccccctcgcccgccgccgtcctcccggacggcggcaagccagatccagccccagaggctttcgacgcggcgccggcctaagcctgcgccgtcggccggatgatgatttcgcccacatcgacatcagccggctgttcgatggcgaaggctatcgcgcgggccaccgcttccggcggcagcgcgaatgcctgcatgctggcggcgatgtgcgctttcaccgcccgattggtcatcgattcggcgaagttggtgcgcgtgaagccaggggagatcacagtgacccgcagcttgtcgccggcctcctgccgcaggccttccgaaatcgcgcgcaccgcggccttgctggccgcatacaccgccatgttcggcaggatgcgctgcgcggcggtggacgcggtattgatgaaatggccgaaaccctgcgcgcgaaacaccggcaaagcagcgtaaattccatacagcacgcctttgatgttgacgtccaccatctgctcccaatcgtcgacgcgcaattcgtcgagaggggagatcgggccgacgccggcattgttgatcaacgcatccagcctgccgtagcgttcgcacgccagccgcaccagccgcgacgcgtcctcccgccgccggacatccgcgcaagtccaggcgcaatgtccgcctgcttgcgctatccgctcggccaggccgcgcaagcgccgctcgccgcgggccgccagcaccaccttcgctccgcgctccgccaacagcagcgcggtcgccgcgccgattccgctgctcgcgccggtaatggccaccaccttgtcttggattgccgccatgatgttctcctttccgcgtgtccagaagcgccatattcatccaaccccgtcgttcaatctataatcaatcaggcaaaattattaattgatcgtacaaatctccatggacccgctttccgatatcttccacctgctcaaagtcgaaagcgtgctgtcggcgcggatcgaggcgcatggcgcttggtcgctgcggttttccgcctaccagcacatcaaattcggcggcgtgctggcaggctccttctggctgtggtttgaagatggcgcgccgccgctccggctgaagccaggcgacttctacctgctgacccaaggacagccgtattgcgccggcagcgatccggcgctcgctcctgtcgacggccgcgaggtgcttgccgcaaacctgtgcgcggatggcattgtacgttatggccagggcggggagacggtcagcgcggcaggcggccgcttcgtcttcgagccccactccagcgccttgctgctgcaagcgctgccgccgctgatccatattccggcggcgtcggcaagcgcgcaggccttgcgcgccacactggagctgctgcgcttggaaacggaggcatcccgccccggcgcgtcgatggccgccgccagcctggccaatatggtgctggtgcaggtgctgcgcgcccacctggcttccggcgcgcatacaccgggctggctgggcgcgctggccgaccccagaatcggcaaggccttgggcctgatgcatgccgacgtggcccggcattggaaagtggaggagctggcgtcggcagtggcgatgtcgcgcaccagctttgccgagcgcttccgggcgcgggtcggcatggcgcccatcgactacctgacccgctggcgcatcgccaaagccggcgccgcgctgagagccgggcaaagcctcgccgccgtcgcccaaagcataggctatggctccgaagccgccttccacaccgccttcaagcgcatcgtcgggcatagcccgggccgctatcgacggcggcaggccgcggaacccgcccaacgctagccgcgcgcagcgcggccaagcctaaaacgggaaagcgtggaagactagcggcggagcagtccggccacgccccgctgccggacaaaacaaagccctcccgaaacgggagggctttgttcatgcggaaccggtgcgatcagtgttgatgcccatgctcgccatgcacatgctggtgagcgatttcctcggcggtcgcctcacgcacatcgatgactttgagggcgaaacgcaggtcttggccgcacagcgggtggttgccgtccagcaataccgtcgggcctttgatcttggtgacgaaatagtagagcggctggccatccgggccgggacgctgcaattggccgcctaccttgatgccgggcgggaaatcagccttggacatggtggtgaccagcgcttcgtcgcgttcgccgaaggcgtcttcggcagccagcgccacagtgatttgaaaaccggactcctggccttcaagcgcggcttccagcttggggaaaagattgtcgtaatcgccgtgcaggtaagagacggggtgcttgccatcgtcgtaaaccagaccctgctgtctgtgactttcatgcgcagggtgacggcggaaaaatggaagcgggaaggttggcagctcaacgcgggagtgtcaactggacgacgccggttctcaagaggatattgcccaacgcgaaaatgccgggggcgcccgcagaagcgaggaattagctatcggattgcgcagtgccatgctgatgcagctttgaagctaaatccagccttgccgcccgaagcaacgcatcggatggcgtggcatccgctctggatcggaacatttccgcaaggttggaaatgatttgcgcaggcgtgatgatcaagccccacggcatgccccaccaaccgaatgcgaaggagaagatgaggcatgcgaagttggtcttccggccacaagaatggcaacaaatatgcgttcgtttggtccatcgcgtaaggatgccgattgaccagacccgatagtaagggcggacctccgtcgtggaggatgccttcttgcacaaggagcaggaaccttgtttgatgcggcatgcatgctggaagatcatgtccgtcgggatatcttccgagatctcaagtaaccgcgcctccctcaggcaagcctggcgacaaaaccgctgccccccatccaccaccgccgagcgcccagcccagctgccgcagaagtcgcactccatccagcccttggtttgacgataagccgccttgcgcgccgcgagagccaatggcggcaatatcgactcatccaggcctctggactgcaacaaggagcggatggcctctttcgcctcatcggtaagatccatcgtagcgtaacgccgcaagagttcttcagtttcctctgccttgaaacgctctaaatggactccccgcgtctcccaaacacaaatctccccgcacaaggaggatgcccaaggagggctggcgactggttctcggccgaagcggtcgacaagctgactatctaacaatggcaggtatgcacaaaaacccggacacgttcaaacgcaagaaatcactaatttgaataacaatggatttcggcagtatttttttgtggcaaatccggcatccgtactcatagcggataccgtcgcgcggcaaatgcggcgtgagcggcagccagctcgattgaagacagcacatagtctgggctgtcagataacttcgatatggccagatcgagaaatgaccgcactcggctgggttgtgccgcccggctgccatagtagacatggagggcaatgggtgcgctcataaaaggcaacagtaccggaatcagacggcctgcacggatatgcggcgctgccgacagattagcaacttgtccgatcacctgaccggccagcatggcctgcagctccaactcggtatcgttgctgtaaaaagcaggtgaaaagtggcgctgcaccacgctgccgtcgatagttagataccagggtgaaaccttgccgctactggggtggcggaaaatactgcaacggtgcgctgccagctcttccagcgtatctggcatgccatgccttgccagataatcagaggcagcgcaaacgattagctggatggggaataggcggcggctgatcaccccatcttgtgccgacgccccgatccgaaagcccacatccacccgttccagcacccagttgccaatgccgtcgtccagctggacatcaggacgaacgccagggtgctcgcggcaaaaagtgtccagcaagggcatcaggatgctggcaaaggatgacttgggcccgacaatgcgcagcggaccgctaatcccctccctacccgcacgggcggtacttactgcgcgctccaatgtagccagtgccggctgcgcatcctccaaaaactgcaggccttcttcagtcagtgccaagctgcgcgtagtccggtgcagcagacgcacccccagatgtttttccagcaaagcaatggtctgagtcgccgcttgcggtgatacgccttgggcctgcgccgccttgcggatgctgccaagctctaccgctttggcaaacatggagatagagcgcaattcattgatgggcatgagagtacctgctgtgtctgccgaattatcaataaaaaattgccactgatgcaaggttttatcggctactcgattgatatttaacgacttatagtcacctcatcaatttgcgctagaggtgaatcatatgaaagaaacccttgtcgtcgtcggagccgggcagatcggccaggccatcgcgcgccgaattggcgttggcaaacagatcatgctggcttcgctacgaatagaagaggccgaacaggcggtggaactgtttcgccatgccggtttcagcgccaccgcagccagtgtggacgtgagctcgcgcgcttctgtcagcgcattggtggaacaggcctgccagttggggccgatcaccgggctgatccacgccgccggcgtatcgccctctcaagcgccggttgccgccattttgcgggtggatctgtatggtacggcgctggtgttggagctgtttggcaatgtcatggcctccgggggctctgccgtggtcatcgcctcgcagtctggccaccgcctgccggcactgagtcagcagcaggatcggttactggcgctgacaccaacggaagaactgctgcaactggattttctgcaacctgggcaagtgcttgacaccctgcatgcctaccagttgtccaaacgtgccaactcactgcgggtgatggccgaggcggtacgctggggcccgcgtggagcgcgggtgaataccatcagccccggcatcatcatcaccccgttggccaacgacgagttgaacggcccgcgtggcgccggctatcgcagcatgattagcgccagcccggtgggacgtgccggaacccccgacgaagtaggccatgtcgcggccctgctgatggggccggatggcacttttatcacaggcagcgacattctgatggatggcggcgtgacctcagccttccgttttggggacattgcacagccggtcgcgcagggaggagcctgattgcgcggcgatcagctgatgcgagacaagattaacgattgaaccattcagaaagaaccgaacaatgagctaccgcgttaaaagttatgcggcacaatcctccagcagtccgctggccccgtttcagtttgaacgccgcattccccgtgcagacgatgtggtgatcgagattctgtattgcggcgtctgccattccgatgtccacaatgtacgtaacgattggggcaatgccaattatcccatggttcccggtcatgaaatcatcggcagggtcattgccaccggagctggcgttactcgtttcaaggagggcgatcacgtcggtgttggctgcctggtggcctcctgccagcgctgcgacgcctgtgaccatggccacgagcagtactgccagaatggcgctacctacacctataaccacaccgacccgatagacggcacgcgcacttttggcggttatagcgaaaagatcgtggtggcggaagactttgtcctgaaagtaccgaatacgctggacctggccggtgcggcacccttgctgtgcgcaggcatcaccacttattccccactgcgccactggaaagtggacaagagcagcaaggtggcgattgtcggcctgggggggctcggacacatgggattgaagttggccaaggccatgggggcggaggtgacattgttcagccgttcgccgggcaaggagcgtgacgcgcgcaggctgggggctgaccatatcgtcatttccaccgatgtacagcagatggccgccattgcgggccgcttcgacctcatcatcaacacggtgccctacaagcatgatgtcaacccctacattccgacgctggcctccggcggcaccatggtgatggtgggctatctggggccgctggataacttcaataccggaccgctggtattccgccgcaaggcattggccggttcgctgatcggcggcattgccgaaactcaggaaatgttggatttctgcggcctgcacggcattcactccgatatcgagctgatcgccatccaggacatcaaccaggccttcgaacgcatgcttaaggctgatgtgaaataccgctttgtgattgacatgaacaccttgaaagagtccatatgaacgccctgagccagaatacgagtcagccctcggagcaaagcttgatgattacgcccgcctctggccgcgacaccgtgtatgcgcctgccgagttttttaccggcagcgtcaaacttgaaatgctgtttacaccggcggggcctgatcgcacttcggcaggtctagtcacttttcctgctggcgctcgcacccactggcacagccatccgctgggacagaccctggtagtgaccgcaggcacgggttatgtgcaacgggcaggcggaccgctgcaaccgatcaggtcgggagatgtggtgcgcattccgcctgaggtaaaacactggcatggcgccgcatcggatagcagcatgaaccacatcgccattcaggaggcgctagatggcaagtctgccacctggcaggaggcggtcagcgatgcggattatctcggtggtaagctagatgtcaatctgagcgatcagagcccgccgtaacccatgtcagtatggattaccgctcatttgctagatacttttatgactgcttccaatacgaaaacagccgtcttttatctggcacgcgaaggacagctttagccgaaaagcggacatctgaagaattgatacgacatcactaaagaagaaggggccaacggccccttctctgttgtcagactccgacgaactttattcggatccgacggactttattcgctctagtcacgttcgcgaatgcccattactccaccgtcaccgatttggccaaattccgcggcttgtcgacatccgtgccacgcgacagcgcgacatggtaggccagcatctgcaccgggatggtgtggacgatggggctgaggatgccgacgtggcgcggggtgcggatcacgtgcacgccgtcggactcgctgaaatggctgtcggcgtcggcgaacacgaacagctcgccgccgcgggcgcgcacttcctgcatgttcgacttcaccttttccagcaacgcgtcgttgggggcgatcaccaccaccggcatgttctcgtccaccagcgccagcgggccgtgcttcagctcgccggccgggtaggcctcggcgtggatgtaggagatttccttcagtttcagcgcgccttccagcgcgatcgggtaatgcaggccgcggccgaggaatagcgcgtcgtccttggcggcgaagcgctcggaccaggccttgatctgcggctccagattcagcgcgtgctgcacgctgcccggcaggtggcgcaattcgtccaggtattgcgcttccatttcagccgatacgcggccgcgcgccttgcccagggtggcggccagcgcgaacaggcccaccagttgggtggtgaaggccttggtggaggccacgccgatttcggcgccggcgcgggtgtagaacaccagatcgctggcgcgcgggatggcggattcgcgcacattgcagatggacagcgcgtactggtggcccagctccttggcgtacttcagcgcctccatggtgtccagcgtttcgccggactgggagatggtgacgatcaggtgcttggggttggcgaaggcgtcgcggtagcggtattcgctggcgatttccacatcgcacggcaggccggcgatgctttcgatccagtatttggcggtgaggccggcgtagtagctggtgccgcaggccaggatcttcacgccttccagttgcggcaggatgccggcggcggcgtcgccgaacagctcggggttgaagccgtagtcctgcaccgcttcgatggtgtcggacagcgccttcggctgctcgtggatttctttctgcatgaagtggctgtacgggcccagttcaagggatgccagcgagacgtcggacagatgcaccgggcgctcgatggcctggtcgtgcttgtccatcagtttgacgccgtcgcgggtgaggtggccgatgtcgccctcttccaggaagatcacgcggcgggtggcggacaggatggcggagacatcggaggcgatgaagttttcgccttcgcccaggcccaccagcagcgggcagcccatgcgggcgcacaccagttcgtccgggcggtccagcgcgatcacgccgatggcgtaagcgccggtcagctcgcgggtggcctttttcaccgcgtcgaacaggctgtcgccggactggtaatagtgatgcaccaggtgggcgatcacttcggtgtcggtttgcgattcgaaggcgtagcccagatccttcaggcgctggcgctgctcttcgtggttttcgatgatgccgttgtgcaccacggcgatcttgccgaaggagatgtgcgggtgggcgttgtattcggtcacgccgccgtgggtggcccagcgggtgtggccgatgccgagctggccttgcaggctttcctcggcggcggcgctttccatttcggcgacgcggccgacgcggcgcacccggcggatttcgtcgccggccagcacggccacgccggccgaatcgtagccgcggtattccagacgcttcaggccatccaccaggatgggaacgatattacgcttggcgatggcgccaacgatgccacacattattttctccttgcactgctgtcttgaactgcgggcgcgcaaatcagcgtcacgcccttcgcttgaatcttgtctctggcgtcctgcgccaggccgtcgtcggtcaccagggtgtggatcttgtcccacggcaactccagattgggaatgcggcggcctatcttttccgactccaccatcacgatcacttcgcgcgccacttcggccatcacccgcgacaggcccaccagttcgttgaaggtggtggtgccgcgctccagatctatgccgtcggcgccgatgaacagctggtcgaaatcgtaggaccgcagcgcctgctcggcgatctggccctggaacgattccgaatgcgggtcccaggtgccgccggtcatcagcaggatgggttcgttctccagctcgcgcagttggccggccacattcagcgagttggtcatcaccaccaggccgcgcttgctgcccagcagcggaatcatcgcgctggtggtggtgccgctgtcgacgatcacgcggttgtggtcgcggatgcgttccgccgccgcgcgggcgatcgcctgctttcgtttcgaaacctggccgacatccggctcggccgccatttcgctgggcagcgacacagcgccgccatagcggcgcagcagcaggccgccggtttccagcagcgccaggtccttgcggatggtgacctcggaggtggcgaaacgctgggtcagctcttccacgctgacctcgccgcgctcctgcaccagggtggcgatggcatggcggcgttgttgggtgtttcgtttcgtcatattaagtttcgtttcgaaagtttttgcatgataacgctcaatcgcatgaaagacaagatgtccctaaagcccgctctccaagaccttgcctcctcggtctcagctatctggacataattcattcgtcatcgcaaaatcaaaatcctgcctattcacctcatgcaaagggagcccgccatgttcggccagcccgcttcgtccacaccatcccaacgagagcaggccctgcaaatcctggcccgaaccgggatcggcaaagccaactatgcgccgccattattccggctgctatggcggttgcaggcgaactgcccgccgccgcatttcctgccgttctggcaggcagctctgctgttaggcttatttctgggcccaagctgggccggattgatgtggctgttgagccatctactggcgtggccgcagccaagcctgccgattttgtccgtcgccgcactggtcatcggcgcgctgtttggcttgagcatggcgctttattacgcatatggccgccgcaaataccggctgccaacatgggaagcgctcgcatcgcctcttgccgcccacaagcgagcatgagcatcgcgcccaaagaaaaacgccctgttccgggagagggaaacagggcgcggcggcgtgagtgaatggcggcaattgccgctgtcaggcctcaggactttttctgcggccgcttccagcccggaatcgtcacctggcgcgcgcgcgccacggtcagctcgccggccggggcggtcttgttgatcaccgagccggcggcgatggtcgcgccgtcttccagcgtcacaggggccaccatcaaggtgccggagccgacgaatacatcgtcgccgatcacggtcttgaacttgttgacgccatcgtagttgcaggtgacggaaccggcgccgacgttcaccttgcggccgatttccgcgtcgccgatataggtcagatggttaaccttggagccatcgccgatcttgctcttcttcacttcgacgaagttgccgatgtgcacatggccggccaggtcggcgcctggacgcaggcgggcgtacggcccgatccggcattcctcgcctaccatggcgtcttccagatgcgagaacggcgcgatctggctgccggcggcgatcttgacgtttttcaacacgcagttggcgccgataagcaccttgtcgcccagctccaccacgccttcgaacacgcagcccacgtcgatgctgacgtccatgccgtgtttcagctcgccgcggatgtcgatgcgcgccggatcggccagcgtgacgccggcttccagcaaggcgcgcgcctgattggtctgcaggatgcgctccagctcggccagctgcagcttgttgttgacgccggcggcttcccagctggcatcgacgctggcgctttccaccgccacgccgtctttcaccgccagctccagcacgtcggtcagatagtattcgccctgggcgttgccgttgttcagcgcgttcagccagccggccaattgcgcgttcggcagcgccatcatgccggtgttgatctcgcggatggccagttgctccgccgtgcagtccttgtgctcgacgatggctttgagcttgccgtcggcgccgcgcagcatgcggccgtagccgctggcgtcggccagcacgtcggtcagcaccgccatgccgctgccggcggcgtcgatcagccgttgcagcgtggaggcgcgggtcagcggcacgtcgccgtacaacaccagggttttgccgtcttgcggcaggtggggcaaggccattttcaacgcatggccggtgccgagttgttcggtttgttcggcccagacgatatcggcgtccggaatccgggcgcgcacctggtcgccgccgtggccgtacaccaccaccaggcgggaaggattgaggccgcgcgcggtgcggatcacccgcgccagcatcggctcgcccgctatcgggtgcagcactttcggcatagtggaatacatgcgcttgcctttgccggcggcaagaataacgatgctgagactatccatgatgatttttttgcttgggccaaaaacggaaaaaggctgccacttgcgtggcagcctgcactatacacgattacatctcgcgcattcagtgagcgcgcttcttgaggtagtccagcgtcttgagctcggcaatcgccaccgccagtgcggcgtgggctttggccgtgctcatgtcgtcggtcgcgtgcttgagggcgtcctcggcagcgcgtttcgcctcattggcgcgggcctcatcgagatcctcgccgcggatcgccgtatcggcgagcacggtgatcaggctcggctgcacttccatcatgccgccggacaccgccaccagtacttcttccttgctgtccggcacgcgaaggcgcaggacaccaggcttgatacgggtcaggagcggcacgtgttgcgggtagacgccgatctcgccttcggtagccggcgcgacgacgaattccgcctcgccggagaagatgagttgctcggtgctaaccacttccacacgcatcttggacatccgccctctccttagttaagggtcttggctttctcggcagcttcttcgatcgaacccaccatgtagaacgcttgttccggcaggtggtcgtattcgccagcgagaatggccttgaagcccttgatggtttcgcgcagcggcacgtatttgcccggggaaccggtaaacacttcggctacgtggaacggctgggacaggaagcgctggatcttacgggcgcgagccacgaccagtttgtcttcctcggacagttcgtccatacccagaatcgcgatgatgtcgcgcagttccttgtagcgctgcagggtggactgcacgccgcgggcgatggtgtagtgctcgtcgcctacgaccagcgggtccagctggcgcgaggtggagtcgagcgggtccacggccgggtagatacccagcgaggcgatgtcgcgcgacagaaccacggttgcgtccaagtgggcgaaggtggtcgccggagacgggtcggtcaagtcatccgcaggtacgtatacggcctggatggaggtaatggaaccatccttggtcgaggtaatacgttcttgcagacggcccatttcctcggccagcgtcggctggtaacccaccgcggacggcatacggcccagcagagcggacacttcggtaccggccagggtgtagcggtagatgttgtccacgaacaacagaacgtcgcggcccttgccgttttcgtccttctcatcgcggaaatgctcggccatggtcaggccggtcagggccacgcgcagacggttgcccggcggctcgttcatctgaccgtacaccatcgctaccttgtccagaacgttggagtccttcatttcgtggtagaagtcgttaccttcacgggtacgctcacccacgccagcgaacacggacagacccgagtgggccttggcgatgttgttgatcaattccatcatgttgacggtcttgcccacaccggcgccgccgaacaggcctaccttgccacccttggcgaacgggcacagcaggtcgattaccttgatgccggtttccaggatgtcggaggcggccgacagttcgtcgaacttcggcgcagcttggtgaatggcgcgacgcgcttcggtcgctaccggaccggcttcgtccaccgggttgcccagtacgtccatgatgcggccgagggtggcggcgccaaccggcaccgaaatcggtgcgccggtgctggctacggccatgccacgcttcagaccgtcggagctgcccatcgcaatggtacggaccacgccgtcgcccagctgttgctgaacttcgagcgtcaggtcggcgtctaccagcttcagggcatcataaaccttcggcatggcgtcgcgcggaaattccacgtcgatcaccgcgccaatgatttgtacgattttgccttggctcattatcgcttcctaaaaataaacttttacagttccgttgacggttacaccgccgcggcaccggccacgatttccgacagctcggtcgtaatcgccgcttgacgcgccttgttgtacaccaggcgcagctgcttgatggtgttgcccgcgttgtcggtggcggctttcatcgccaccatccgcgcggcctgctcggaagccatgttctcggccagagcctggtacaccaccgattccagataacggcgcaccaggaactccatcagcgtcggcgcatccggctcgtacaggtaatcccacgagtgcgaatgctccaccaccatgtggtgcggggtcagcggaagcagctgttcgagtgccggctcctgcttcatggtattcacgaagctggagtagacgatgtagaccgcgtccagttcgccttcggcgtactgcttgaacagaaccgtaagcgggccaatcagtttttccatcttcggcgtatcgccgagatgaaccgcgcttgccaccacgttcagacgagcgcgctgggcagctcccaggcctttttggcccaggcagcaaacgtcgatttcgacgttctgatcctgcagttccttgaccttggcgaagaagcgcttgaacgagttcacgttcaagccgccgcataggcccttgtcggaggaaaccaggatgatgccggcgcgcttgatcgtctcgcgacgggcaagcaaggggtgaccaagttccgcgttcgcctgagcgaggtgcgccataaccgtgcgcaccttctcggcgtaaggacgggcagcgcgcatacgctcttgcgttttgcgcatcttcgaggtcgacaccatctgcatagcgcgggtgatcttctgcgtgttttgcacgctgcggatcttggtgagaatctctttaccgactgccatatcctgaacctttctttagcaacgacttatcgtctaaggctcagttgaagctgtagccagccttgaacgattccatcgccttggccagtaccttctcgttgtcggcagacagatcaccggaagcgttcacggcctgcagcacttcggcgtggttggcacgcacgttggccaggaactcggcttcgaaggccagggccttcttcaccggaacgtcttcgtacgagcccttgttcaccgcccacagggtcagcgccatttccgcggtcgacagggtggagaactgcttctgcttcatcagttcggtcaccacttcgccgtgcgacagctgcttgcgggtggcttcgtccagatcggaagcgaactgcgcgaacgcagccagctcgcggtactgggccagagccagacggataccgccgccgagcttcttgatcaccttggtctgagcggcgccgcccacgcgcgataccgagataccggcgttgatggccggacggatgcccgcgttgaacaggtcggtttccaggaagatctggccgtcggtaatcgaaatcacgttggtcggaacgaacgcggaaacgtcgccggcctgggtttcgatgataggcagagcggtcagcgaaccggttttgcccttaacggcgccgccagtcagcttttccacttcgtcttcgttgatgcgcgcggcgcgctccagcagacgggagtggaggtagaacacgtcgcccggataggcttcgcggcccggcggacggcgcagcagcagcgagatctgacggtaggcgacggcttgcttggacaggtcgtcgtacacgatcagcgcgtcttcgccgatgtcgcggaagtattcgcccatcgcgcagccggagtacggagcgatgaactgcagggcggcggcttcggaagcggtggcggccacgatgatggtgtgacccatcgcgccgtgctcttccagcttgcgaaccacgttggcgatggaggaagccttctgacctacggctacgtagatgcagatgacgccattgcccttctggttgatgatggcgtccagcgccacggcggtcttgccggtctgacggtcgccaatgatcagctcacgctggccgcggccaaccggaaccatggagtcgatcgacttcaggccggtctgcatcggctgcgataccgattgacgcgcgatcacgcccggagcgatcttttcgatcggggacgatttcgtggcgttgaccgggcctttgccgtcgataggctgacccagagcgttgaccacgcggccaatcagctccggacccaccggcacttccagaatgcggccggtgcacttgacttcgtcgccttcggagatgtgctcgtactcgcccagaaccacggcgccgacagagtcgcgctccaggttcatcgcgaggccaaaggtgttgcccggaaattcgagcatttcgccctgcatcacgtcggccaggccgtggatgcggacgataccgtcggtcacggagataaccgtgcccttggtgcgaacttcagcgccttcagccagattctggatcttggccttgatcagatcgctgatttcagaggggttcaactgcatgatctctcctaattcttgaggcttgctgccattgcttgcagtttgccgcgcacggaagcgtcgatgacatcgtcgccaaccagcacacgcaccccgccaatcaggtcggggttttcacgcacgtcaagacgcacggtcttgccgtacttcttggaaagcgtggtggtcagttcggcttgttgtgcatcggacatggcaaaagcggactccacctgggcgtccactatgtcttccgattgcgccttcagcagttcaaactgcgcggcgatttccggcagcagcgtcaaacgggcgttctcgatcagcgcggcgatgaagcgtttcacgtcttcgttgccgcggccgccgagcacatccagcatcagcgcctcaacctcttgtgcggtatgtttcggattggtgactacctgcgccagatccgggttgttcaccatggcagccagccacgacagcgcatccgaccactgatcgaggctacgctgttcggtggccaggctgtataccgcttcggcgtagggccttgcgacggtaatgagttctgccatgagttaattaaaactccgctttgatggaggcaagcaggtcggcgtgcttggcggcgtcgatttccttgcgcaggatcttctctgcgccggcgacggccagttcggccacctgcgcgcgcagggattccttggcgcgcagcacttcctgatcgatttccgacttggcgtcggccacgatgcgggcaccttcggtgcgggccgcgtccttggcttcgtccacgatctggttggcgcgcttctcggctgcaaccacgatctcggtagcttgctgcttggccttgcggatttcgtccgcaacgcgcttttcagccgcttccagatcctgcttgccgcgttccgcagcggccaagccatcagcgatacgcttggcccgctcatccatcatgttggtaagcggaggccaaacaaacttcatggtgaaccataccaggatggcgaacgtgatcgcctggcccagtagtgttacgttgaattccacgcttgttttcctccagagtatgactacaacaaccgtttacacgtatccgtcggcagacggattagtgggcagccttgacaacggccagagcggcagccaggaacgggttgttgaaggtgaacagcatggcaacaccgacaccaatcatggagatcgcgtcaagcagaccggcgatgatgaacagcttggtttgcagaaccgggatcatttccggctgacgagcggaggactcgaggaacttgccgcccagaatggcgaaaccgatagcggtgcccagagcgcccagaccaatgatcagggctgcagcgatagcggtcatcgactggatctgagaaacgagtgcttccattgtgtatctcctaagacttaaagcaaggatggttggtaaaaaagtatggtgaatctacaggtaaatcagtgcgcttccactgccaggctcaggtacacgatggtcagcatcatgaacacgaaggcctgcagggtgatgatcaggatgtggaagatcgcccacggcgcgcccagcacccactgcaggccccagggcagcagcgcgatcaggatgaagatcaattcgccggcgtacaggttaccgaacagacgaagagacagcgaaatcggcttggcggccagctctaccagctggaacgcgaagttcagcggggccaggatcacggcgcccaccgggtgggagctgtggaacggcgcggtcaacagttccttgccccagccgcccaggcccttggccttgatcgagaagccgacgatcaggatcagcaccgacagcgacatggcgaaagtggagttcacgtcggcggacggcaccacgcggaagtacacgtgatgcggctccaggccgaagaaggtgtagccgatccattgcgcggccatcgggaacagatccaccgggaacaggtccatgaagttcatcaggaacacccagcagaagatggtcagcgccagcggggcgatcatcttgctcttgccgtggaacacttcgcgcacctgggtctgcaccagctcgatgatcatctcgacgaacaattgcagacggcccggcgcttcgatgctggcgcggcgcgccaccatggcgaacacgcctacgaacaggaagccgagcagcagggagatggagaaggtgtcgacgtgcaggctccagaagccggccgacgggtccgagttccagaacgtgaggtggtgcttgatgtaatcagttgcgttgcttgccatcgctcttttctcaatttttgattagaagcccgaaaccgtagccggagatggcggcaaagaacccaccgagaaagccgactacggacaaatccttgaaaccagccaaaaccgcgccacttagtagtacggtcaggcaaaactttaccgcttcggccagaaaatgcgccttgatcaacgccgcgggaggaacatgccgcttggcataggcgatcctggcgtacaccagggccggcaccagcaccacgatcccgcccagcaaggtggacactgccaccaccaggctgccggcgccgacaagcagcgaaatcagcactgccagcccgaccaggctggcctgcaggcgcagcacgcgcctcacttccggatttaccatgactgccagtgcaaaaaaaccgctggattataggctttgcgcttgagttgcgtcaacttcgccgccaggcctattttgcggcgcaacattttcatttttgaggttttttctgcagtttctccagcagcgcgtccagctcgtccaggctggcatattctatgaccagcctgccgtttccgccgtttgcatgacgaatgctgaccttggcgcctatcgcttccgacacctggttttccagccgctcgacatcgggatcgacgcgattttgttgcgcggcaactgtggttttttgcgcatcatgctgttgcactcggcgctccacctcgcgcaccgacatccccttgcgcaccacctcctgcgccagctccagctgcgcgacggtgggcagagacagcaaagcgcgggcgtggcccatctccagttggccttcgtgcatcatctgctgcagcggttgcggcagcaccaacaggcgcagcaggttggacaccgcgctgcgcgaacggccgaccgcgtcggcggcggactcgtgggtgaggccgaattcgtcgatcaggcgcttgatgccctgcgcctcttcgatcggatccagctcctggcgctggatgttctcgatcagcgccatcgccagcgccgcttcgtcgggcacgctcttgatcaccaccggcacttcgacgagaccggccttgcgcgacgcgcgccagcggcgctcgccggcgatcagttcgtagtcgcccaggcccagatcgcggacgatcagcggctggatgatgccctgcacgcggatggaagccgccagctcctccagcgcggtttcgtccatgaaactgcgcggctggtatttgccggggcggatgctgtcgatgggaagggaagtcagtctgtcgtccaccgtgtcgacggtggacaggagcgcgtcgagtccgcgccccaatcctttgagtttggccatattgtcagacggtgggagttgcggttgcgggttctagtcgttcgatcagctcttgcgccagcgtcaggtaagcctgcgcgccgcgcgagttgcgatcgtagaccagccccggcaagccgtggctgggcgcctcggccaggcgcacattgcgcgggatgacggtctggaacaccttgtcgccgaagtggcgcgccagctgcgccgacacttgttgcgacagattgttgcgggcgtcgaacatggtgcgcagcaagcccatgatctcgatcttggggttgaccgccagccgcaccttgcgcagcgtggacaccaggtcggacaagccttccagcgcgtagtattcgcacaccatcggaatcagcacgctgtgcgcggccaccaggccgttcagggtcagcaggttcagcgacggcgggcagtcgatcagcacgtagtcgtactggtcttccacctcagccagcgcgctcttcagccgcgcctcgcgcgccagctcgttgaccagctccagctcggcgccgcccagatcgcgattggccggcagcacatggtagccgcccgccttggcgtcctggcgcgcctcctccacgctggcctcgcccaacagcacgtcatagccggatttctccagcgactgcttggcgatgccgctgcccatggtggcgttgccctgcgggtccagatcgacgatcagcacccgcttgcccagctcggccagtccggccgccagattgacgacggtggtggtcttgcccaccccgcccttctgattggccaccgcgatcacgcgtggattcattgcagcaccatcctcaccagatggcgttcggcgtccagccccggcaccgttaccggcagcacctccgaaaccgccacgccttgcggcagcaaggcgatttcctcatacggatacacgcccttcatcgccacgtactggccgtcttcagccatcaggtggcgggtcagcttgacgaactcggccagttccgagaacgcgcggctggtgatgcgatcgaacttctgctccggctgataggcctcgacgcggtcggtcaccacctggacgttggccaggcccaattccaccaccacctggcgcaggaaggtggttttcttgtggttagagtccaacagcaccacctgcatatccggccgcgcgatggcggtgggaatgcccggcatgccgccgccggagccgacgtccagcatgcgcgcgccgccggccaggtgcggcaccaggctcaggctgtccagcagatgatagctgaccatccgctcttcctggcggatggcggtgagattgtaagtctggttccatttcactagcagcgctaggtagcgctgcagcaaaacctgctgcgattcagtgaagtccagggccagcgcggccagcccttgctgcaattctgcgatatgttgtgtcatgcggttttcgtggcgtcggtgaagccgcgcttcaagtgcaccatcaacagggcgacggcggccggggtgatgccctgaatgcgcgaagcctggcccatggtttccgggcgctgctggttcagcttctgctgcacttccttggacaggcccttcaccagactgtagtcgatgtcgcccggcagacggatgtcttccagattgtcgcggcgcgccagctcttcgttctggcggttgatgtatccctggtatttgacctgaatttccacctgctcggcaaccacctcgtcaagctccggcgcgccggccgcggcgtccggcaccgacatcaggtcgcggtaggcgacattggggcgcttgagcaggtcggacagcgtgtattcgcgttcgatgggcttgcccaacacgttcgccagcgcgtccggggcctgcagtttggacggatgcagccaggtggccgccagccgcgccttttccgcctccacggcatcgcgcttgcggcagaaggcgtcccattgcgcatcgccgaccaggcccagcttgcggcccatttcggtcaggcgcaggtcggcgttgtcttcgcgcagctgcaggcggaattcggcgcggctggtgaacatgcggtacggctcggacacgcccttggtgatcaggtcgtcgaccagcacgccgaggtagccctcgtcgcggcgcgggcaccaggcggcttgctcacgcacgtacaagccggcattgaggccagccagcaggccctgggcggcggcttcttcatagccggtggtgccgttgatctggccagcgaagaacaggccctgaatggccttggtctccagcgaggccttcaggccgcgcgggtcgaagtagtcgtactcgatggcgtagccggggcgcaggatgtgggcgttttccatgccgcggatcgagcgcacggcggccagctggatgtcgaacggcagactggtggagatgccgttcggatagaattcgtgggtggtcaggccttccggttccaggaacacctggtggctgtccttgtcggcgaaacggttgatcttgtcttcgatcgacgggcaatagcgcgggccgacgccttcgatcacgccggtgaacatcgggctgcggtcgaagccgctgcggatgatgtcgtgggtgcgctcgttggtgtgggtgatccagcacggcaactgcttggggtgcatgtcgcgcttgccgcggtaggagaacaccggctccggcgtgtcgcccggctgctcttccatcacggaaaaatcgacgctgcggccgtcgatgcgcggcggcgtgccggttttgagccggcccaccggcaggttcaattcgcgcaggcgcgcgcccagcgtgctggccgcctggtcgccggcgcggccgccggtgtagttttccaggccgacgtggatcttgccggacaggaaggtgccggcggtcagcaccacggtcttggcgcggaaggtgatgccgatggcggtgatggcgccggcgacgcggtcgccgtccatcaacaggtcgtccaccggctgctggaacagcgtcaggttgggctggttttccagcatctcgcggatggcggccttgtacaggatgcggtcggcctgcgcgcgggtggcgcgcaccgccgggcctttggaggcgttgagcgtgcggaactggatgccgccgatgtcggtggccagcgccatcgcgccgcccagcgcgtccacctctttcaccagatggcccttgccgatgccgccgatcgacgggttgcacgacatctgacccagggtctcgatattgtgcgtcagaaggagggtggcgcaccccatgcgcgccgcggccagcgcggcctcggtgccggcgtgaccgccgcccaccactatcacgtcgaagcttgtcggataaatcatggctgaaagagcaaatctggcggaaaaacggcctattctacgccaaaacggtttagctgataagtccttgatttcaataaatccaagcgcgtaacgctatcgtcaagccacggtcatcacaaggtcatcgcgcggacattagcgcgtcaaacagcccccctagcatgtggctcatcaccacagggggcaaaacatgctgctaaatgaacagcttgcaggcagaagcaaaccgcggctggccgtgcgcctggccgccggcgccgaagacatccgccgcgcgcagaagctgcgctacgacattttcgccggcgaaatgggcgcggaactggcgtcgcgggatttgggcatagattgcgacgaatacgacgagctgtgcgaccacctgatcgtcgaggaccacaacagcggcatggtggtcggcacctaccgaatgctgtcccccgccaacgcgcgccgcgcgccgcgcctgtactccgagcatgaattcgacctgtcccgcctttcccatctgcgcgatggcttgattgaaatgggacgttcctgcgtgcaccgcgacttccgctccggcgcggtgatcgcgctgctgtggtcgggcctggccgactacgtgagccagcgaggcggcgaatacctggccggctgcgccagcgtgtcgctgaccgacggtggccaccaggcggtcagcctgtatcgccagctggagggccaatacctggcgccggcggaatggcgggtgtttccgcacttgccgctgccgctggaccgagtggtggacgacaccgcgccggtgccgctgccgccgctgatcaagggctatctgcgcgccggcgcccacgtctgcggcgagccggcctgggacccggacttcaactgcgccgacttcttcatgctgctgccgatgagccggctgaacgcgcgctacaacaagcacttcatcggttgagtccgcggggcgcgcgccccgcgccgcggcccgcggatgctacaatccgggcatgacttacgctttcgaagcggtgggcgtgatccgctcgccctaccgcgaaaaattcggcatcccgcgccagccgtcgctggtcaacgccgcccgcgtcaccctggaattgctgccgccctacaaccaccccgactgcgtgcgcggcttgtccgagttttcccatgtctggatcagcttcatcttccaccagaccatggcgcgcggctggcaaccgctggtgcgcccgccccgcctgggcggcaacgccaaggtgggggtgttcgccagccgcgccacccatcggcccaatccgttgggcttgtcgctggtggagctggccggcgtggagtgcgacaacggcgtgcggctgcatctggccggcgccgacctactggacggcacgccggtggtggacatcaagccttatattccgttcgtggaatcgcggccacaagcccgcggcggcttcgtcgacggcccgccgccgcagctgacggtgcgatggagcgaacaggccttgcggcagctggccacgctggccgcgccgcccgatctggcgctgctggtggagcaggtgctggcgcaggacccgcgcccggcttaccaggacgaccccggtcgcgtctacggcgtgtcgctgtattgctacaatatccgcttcggcatccgcgaagacatcgccacggtgcttgaaattcttgaataaaaccaaaactaaatcgcatctccccggtcatacccgggcaactcaaaccactcaggaaaataaaacatgaccactcgcgcgaagacgatcgtactcgccttcaccatggtttccgtgttggccactccctttgccgaagccgcgcgcctcggcaagggcaagagcgcaggcatgcagcgctccgcccccacccgcacctatcaacccagcaccccggcgccgcaaccgatggccgcgccggctccgcgtccgggcgcgccggcccaggccgcgccgcagaaatccggcccgggcatcggcaccgcgctggcagccggcgccgtcggcgccgcggccggctacatgatcggctcttccggcaatgagaaacaggcggctccggcgcagcaaaacgccgcgccggtcgaacaacccgcccagcaggccgcgcaatcggccccggcccaacaggaaaaaggcggcatgccctggggcatgctggcgctgctgggcctggccctggtcggcggcatgatgttcttccgccgcaaagcgggcaatccggccgccaacgcgccgcaaccggccggcatgccgcagggcatgaacagccaggccggcggtttcgacgccgtgcccaagatcggctccggccttgacaacggcaacagcggcttcggcggcggcttcaacagcgcggcgccggccggcggcgcgcctgcgcgcctgcccgacggcaccgaaacccccaacttcctgcgccaggccaaggctaccttcctgcacctgcaaagcctgaacacgccggaaagcctggaggaagtgcgcaagtacttgacgccggaactgttcgaagcgctgcgcggcgacatcgccgacaacggcgccgtggccgacttcccgcagctggactgccagctgtccgacgccagcgtcgagaacggccgctacatcgccagcgtgcgcttctccggccaggtcagcgaagaagtgaacgccccgctggcgccgtttggcgaaacctggcactacatcaaggatggcaacaccggcggcaagtggctggtggcaggcatccagcaagactgaggctggcccggcgggatgtggtttttcccgccggcttaacactcgttgacgacgggccctggggcccgttttttattttaacggccatgcactaaactggaatgccgattgcttgagcagcggggatacggaccaacagagcccggacacaaggaggcagtatcgccatgacagcattcgagcacgccggcctgaaaatcggcagccactttcagcccatctacagcctggcgcatcggcgcagcataggcgtggaggcgctgttgcgtgccgagcagggcgatgtcgcgctcagccccgccgaggccttctacaccgccgtctcgccggaaaagcgccaccagctggacctggccgtctgccaggcgcacatccagcgctttctgcagctgccgtccgatcagccgcgctggctgtttctcaacctcgacgccgcctcgctgtcgcgccccgaccgcgcgatggcgctggtcaacaacatccgccaggccggcctggagccgcacaaggtggtgctggaagtgctggagcacgtgctggaagtggacgaggcgctgatcgaaggcgtcaacatcctgaagaacaacggcttcatgatcgccatcgacgacttcggcgtcggccactccaacctggagcgggtatgccagctggagcccagcctggtgaaattcgaccgccagctgctgcgcaacgccatccagcagccgcgcagccgcagcctgctgaccaggctggtgcggctgatgcacgagattggtgcgatggtggtggtggaaggcatagaaaccgaacgcgacgtgctggtggcgatggattccggctgcgacctgatccagggctacttcatcgcccacccggccgagcagcctaccagcgacgagatcatcacccccaagctggacgaacgctgggacgaattgatggcgcacgcgctgctcaagcgcaagctcacccgccgccagatcgagctggcgcggcaatgcttcgtgcaaagcgccatctcgctgatgcagggcaccccgttcgacctggccgccaaaccgatgctcagcctgccggacgtgatccgctgcttcctgctggacagcgagggccggcagataggccgcaacctcaacagccgccagtccaccgccgccaccgacccgcgctacgcgccgctggccgacaccaccggcgcggtgtggtcgcgccgcagctatttccagcacgcggtggaccagcccggcgtgctgtacatgagcgagccctacctgtcgatgaccgacccgcgctcctgcgtgacgatgtcgatggcgatagagatcgacgaatacatgcacgtgctgtgcgccgacctgctggtgccgcaggccagcaccgtatgaaaaagggcggcctccgggccgccctgccgtccggctagatcacctcagccggcagcttgatgtcttccatttcctgcaaaatcggctttttgccggaacaatacaccgtagccgcccacttctctttcacatacacatgcacgccggcctcgaccggcaggctttcgacattcctgtcaacaccccagaaaacggtgtaaaccgtatcgccgttcggcacattcacggtataggacggcgaacccacgccagtccactgccccgtgctcgcgcgcttgcgctccacgctcagcgcgatttccggcgcgcctggcttgccgaaggcatagcggatggttttgcccgcatcgcacagctccaccttcttgccagccttggtcgtgcaggcgaacaccgtcttcgccccggctccgcagtccgcccacgccaaaaccggcagcaaggccagcggcaacaacagcttgtttttcatttttctctctcgtttcatcacgcagcagggccgatgcgccccgcaaaaaaaacggcggcccgcatggaccgccgcttctctctcccagccttactgcgccggggtcacatcctggatgtattcgaacagcgtcaccaccttctgcacgccggcggtttcgctggccacccgcgccgcctcggcgccttcaccctgggtcaccaggcccagcaggtaaaccacgcccgcctcgctcaccaccttgacgttgttgggattgacgcccttgccatccagcagccgcgcgcgcaccttgctggtgagccaggtatcgttgctgcgctcggaaaaaccggacaccggcgccaccaccgtgtagttgtagacgcggcgcacattgggaatgccgcgcgcgatcagctcggcctgctggcgcgcctcgtcgctgggcacttcgccggtgagcagcaccgcgcggttgaagctggtgcggttgacgtgggaggacggcaggcggttggcaatctgctcgccggatttcagctcgatcgcctgatcgtcgacatacgcgccgctggtgcggcggtcggacgccaccagcgccccgccggctgcgcccgcggccaccaggccgacgcagccgctcaacacgctggcgcaaccggcggccagcaacaatgcgaatacactacgcttcattctcattcccctcccaacagcatgcagtcgatggcgtcgcacagcgcgtggatcagcaggatgtgcacttcctggatccggcaggtgcgcagcgacggcacgttcaaatgaatatcttccggcgacaggatttccgtgatcttgccgccgtccttgccggtgagcgcgatcacgctcatgccgcgctcgtgggcggcgtaaatcgcctcgatcacgttggcggagttgccggaagtggagatcgccagcagcaggtcgttggtatggcccagcgcccgcacctgcttggagaacaccatgtcgaaatcgtaatcgttgccgatggcggtgagcgccgaggtgtcggtggccagcgaaatggccgccaggcccggacgctccttctcgaaacggcccaccatctcggcggcgaaatgttgggcgtcggcggcggaaccgccgttgccgcaggccagaatcttgccttcgttcatcaggcaggccaccatccgctccgcggcggccgccacgccaggcgacagcagctccatcgcctcctgcttggcggcgatgctttccaggaaatggccgttgacccggtcaatcagatccattgggggatccccttctctcaaacttactgcgtgaaaatgttcttcagccactgcggcttggcgccgcccacgctcaccaccgcgtcaaagcggcaggacgcgtcgatcttgtggctggctagatagacctcggcggccagcagcagtttccgctgcttggcctgggtaatgctgtcggcggcgctgccgaagcggctgccgccgcgatggcggacttcgatgaacaccaggcacgcgccctcgcgcatgatcaggtcgatctcgccgccgcggcaatgccagttgcgcgccaccagcttcaggccctgggcctgcagcagcgccagcgcgcggtcttcggcttcgcggcccgcctggttcatcgcagcgcgttgccgcccatcacgccggccggcagctggcgctcgaacacccggtcgcggcccagcttcaagtccccggtcacgccgtccagccgcaccgccgcgccggggcggctggccgccatctgcaccgccagccggtaagcgtcgatacccagcgcgtacagccgctcggtttgcggcgtcagcgcggcggccgggcgcgggtagcgcttcaccgccggatggtccggcatcaggaaccacggcatgtcgatgaagcgcacgccggccagctccggctgattgccgccgatattcaattgcgaggtgccgtacaccggcatgtccggcgtcagcgccgccttcagcttcgccgcctgggcggcgtccagcgccagcgccagcgcatcggcctggccgctggcctccagcagcgccggcaggttgccgccgtcaaacggccggcgctgcgcgtccttgccggtcagcgcgcgccattcgtcggcaaacgccttggccagccgctgcgacaacgcgtcgccgccctccaccaggagcggattgacgcggccgtcgtcgcgcatcagccgcgccagctggcgggcttcgccctccaccaccagcgacagcgaaaacagcttgggattggccgccgcctggcggtcgatcgaattgagcgcgatggtgggcaccgtcaccgccggcgccaattgggcgatggcctcgcgcgacagcgggccgatcaccacgttgacgccgtcggccaccgcggcgcggtagcgctgcaccacgttgtcggtggtggcgtccacgctcaccagctcggcgttctgctccacctgcgccgctgcctccacgccgctgcgcaccaccgccgcggcctcgcccagcgccgacgattccaccggcaagatcacgcctatgcgcacccgggcgcgggccgcgctcctggccgccggcgcgctggctagcgccgccaatggcgcggccgccacgggttgggccggcgccagccgcggcgtctggcccggcggcgcgctcagcgcgcggatcggcgcgctattgctttgaatgatatagtcgggggtttgcgccatcgccggcgccaaccaagtcaacaagacgccaaccaacagcggagtcagtctttgcatacgtcgttcgcccacctgcttgatgctgccagggaaagtttctgtcgcggcacattatatgtggtggccacgcccattggaaatctggccgacatcagcgcccgcgccctggcggtcttcgaagcggccgacgtcgtctgcgccgaggatacgcgggttaccggccagttgctatccgcatatggcatccgcgccaagcgcctggtcagcctgcgcgaacacaacgagcgcggcatggccgaacaagtggtgcgctggttgggcgaaggccagattgtggcccaggtgtccgacgccggcaccccggcggtgtccgaccccggcgcgcggctggtggaagccgtgcgcgccgccggccacccggtgcgcccgctgcccggcgccagcgccgtgatcgccgcgctgtccgccagcggcttcaccgcccccaccttcctgtttcacggctttttgccgcccaaaagcggcgagcgccgcaagacgctgcagcaatggctggacgcgccccacctcaccatctgctacgaagcgccgcaccgcatcgtcgacgcgctgcaggacatcgtggcggaactgggcggcgaacgccgggtgatgatagcccgcgagctgaccaaaacctttgaaaccttccacgcgctgccggcggcggaactgctggaatgggtgaaggccgacagcaaccagcagcgcggcgaaatcgcgctgatcctggacgccgcgccggccgcagcccccggcgcagacgacatgccggccgaagcgctgcgcgtgctgcagctgctggcggcggagctgcccaccaagcaggccgccaccctggccgcccagatcaccggcgccaaccgcaagcagctgtacgaccacgcgctaaaactgaaaaaagactgagcgccaactatttacaagccgttggcgcaaggttaatatccgtgtctcgcaggtgtcgcccggatggcgaaattggtagacgcaggggattcaaaatcccccgccgcaaggcgtgtcggttcgagtccgactctgggcaccagcgacaactccgagagagtccgagaagtaccaggaaacccgcacagcacaaggctttgcgggttttttgttgtccatttccgtccggactcatccggccagatccagcatttttgtgtatagaaccgtgtatagatgccaacgcagggctaaaatctatacacaccctcctcagaggcccgcagctcaaggctgcgcgcccatcgccaccaagagcgaatctatacacaggaatctatgcacatggccctgaccgaccttgccatccggcaagccaaaccccaagacaagccctaccaactcgccgacggcgaaagcctctatctcgaagtgtccccatccgggggcaagctctggcgcttccgtttccgctttcaaggcaaggccggcatcctggccctaggcaagtaccccgctgtcggcttgagcgatgcgcgccagaaagcccacgaggcgcgagtacagctcgcccaaggcatcaatcccagccaggccaagaaagaagccaaggttgtcgcccagatcgcggcaaccaacgctttcgaattggtggccagagagtggcatgaaaagcagctcgaccgctggacgccagatcatgcgaggcgagtgatggactcgctggagatagacgccttccccgacctaggcaagctgcccgtacccgacctgaccgcccctctcatcctgaacaccattctcaaaatcgaaaaacgcggcgcagttgaaaccgcgcaacgggttttgcagcgcatcagcgccattatccgctttgcgatccaaaccggcagggccaccgataacccagcagtcaacctagtaggggcgatacgcgcaaagaaggtggaacaccgcccagcactgccacgcggcgagctgcgcgagttctaccgccgcctggcgaccgaacctctctacattccgacacgcattgccatgcatctgctgatgctgaccttcgtccgtcctggcgaactgcgcgccgcgcgctgggaagagtttgatgaagaacgcgccgaatggcgtattccagccgaacgcatgaaaatgcgcgagccccaccttgtacctctatcgcgccaggcgctggagctgctgaaagaactacgcccgctgaccggcaaaagcgcgctgctcttccccgccgtgactgacctcaagaaaccgatgtccgagaacacgctgggctatgccatgggacgcatgggctacaaaggcacggcaacccctcacggcttccgtgcccttgcttccacagttcttaacgaagaaggctttgatccagatatcatagagaagcagctcgctcacgccgagcgcaataaaatacgcgccgcctaccatcgagctgagtatttagaagagcgcaggaaaatgatgcagtggtacgcagaattcttagacagccatcaatcaaggtgatatctcaattgcagacatttcagcgcgcctggattatgtttatggctcgatgagaccttcgatggcaatacgagaggtgtgatagcaatgctgttagcccgaatccaacgcgatttatttgacttcacatgccaagaagaccctgaggacttcggtcctctcttgaacttctggtatcgcgcaaacacccctgcactttctgcggctctcactgcacagcctgggctgaagctgattattgatgctccgagtgttcgcgcgcttgagcagatgtcgcaaaaattatttcttcttgccgacaccattgtcttgcgtggattgttaccagaacctccccgtaacctagagctcctcgagcccgaatatttagcgccaacagggagttacaaacctggctatgctgacgaaatcgtttctcagctagagaagttacaaccctctcccctaaccttaatgagccctgcaccgttctggacatccaccgccaagaccttgaaaaatgggctacacgccgcttacgccatggatatggatagaggtactccaagagagattgtacagtggatatccggtcccggtaggccgcttcttgagtcagggcggcttgcgtatgctccatttattccttcacttgaaatggagcatgagttcctccgtcagagagtggatctttctgcatacttcaatacctcgccttgcttccatcactctgtagattggctaaccaaggagcagctcgatgttttgttttcattgcagttcccctgcttggatggcctcgatctagatactctggcaaaaataaaatacgactaccacgaagaattcgagacctttagccgcctaatgctgaactcactcaataccgtcaaggcagctgtcaataccgaacagttcgccgcagaagtgcgcaacgttcaacgcaacatgattgatgcgggtgtaagtgatgtagaaaagactttcaagaaaatcgaaaatctttcatcgttacgcaaaaaagggatggttatcggcctacttggattgaatgcggcagcgtacttaggggcgcctgagcttttcctcgtatccggcctagctgctgccggagtaaaaatggtagcagataagattgatgagctaaaagaacaaagtcaattaaaagaattccaacactactttctctggaaggtccgtcaccagacaaagcactctcattagcggatactatcatgtcttaatgctaaaaatctggcgcagtcaaagaaaaacatgaaggtctgctttttcgaaggcgaagggccgcttcgagttgttttctttcattaactacagtcgacatttaaccagagctttcgttgtatatgccggtgatttgagatcaaattctcgtccaagatcgtcactcatttttcatcgcacgcattactagcttccacgaataagctaactgtacaagatttttagtgttacacccacaaattttggctaatttaaattttctaacacatgcacaaattgcatgcaattcttggcaccaaatttaaatcagagttaatatctttctgaaaagcgactacctgaaatgggcttgatgctaaaaattaccttaggagattcggtgcctagcattcgaaaaaaattgattctatgcaatcagtgcaaaagcaaaataccagcaggggcgaagatgtgctcagtgtgcaagtcctatcaagactggcgccaattcgttcccttttccagtacagcagtcgccctactgactgcacttatttccgttattggaattgtagtacctccaatttataaaattgttcacaagcctcactcagaggcggcactcatgatgccatcagtagatggcacaactcttagagtcgttgcaattaatcgtggcgatgcaccagcctctcttataaaagcgtgggtagacagtcaatacctagcacctgcgactaaagttaaattgagaaatgattctgaagccatcataaacccaggcagtcagttaattacatttgatattattccgcttctgaacgaaggcgaatcttaccgtgactccttggaaatgctaggtgttgcaattaataaaaaatccgcaccacgaactgaaattcgctttcatgttttgcagtctgatggacgttttgcagtccaagcaatttcattagattccgaacagctattttccttactacgtgcaaatgctgatcgttgctcagccatcaagacagctaactttgaaaatggatgtattggtcgaggagatccgtcaaaataaccagttttggggccagttgcatattcgataattttttgatgaaatcgagttgcgtaccaatcgacaatgcgtaggaaacgtgtccaagtttatgtgttaatcagtcttttgttatcgattggtagactgacaactccggacaaatgggaagatattaacagattgagttctaacctcttctttggatcgattcctgccacagcatgcgttttaatgctcaattggcccatctacctgtcccataaataaccgctgctgaatgctgctctccaatgagctacgttcgcatgacgcacgtctgccatgcctggcagcactgccgggcattaatggcctctctttgcctccagcccccagcgcgcgccatcgaagccccgcctcgcccccgcgcttcatgtgccgctaatcatgcacctgcatgaacccgctccaggcccgcaccgtatggcttggctcgctgttttctccctgccaaaattcatgcgttctcatgcactctatgcatgcattcgcgcttttcgctgactgaccttttcgccctttcctctcgcttcccgcctaaatctgccgccgagtgtgtccggtgcgatccgtattcgtccgatatggtccagttattcagtaattgccctgctgatttccgtttcctcgtctgtcgtcaatagccaaatccgtgtttttccggcttttcaagtttcgttgttgtgtggcgattccacacaacaagcccgccaaactcgatttgaaatttctgaaatactgcattcgctgatcggcgtatccgattgcatccaccgatattcagacaaaacgataaggacaaatccaatgaccgccattgccccttcgctcaccgcccagccgctgcgctttctgcgcttgccggaagtcatctctacgtgcggcctgtcccgctcgtcggtatacgacgccatcaagcgcggcagctttccggccccggtgccgttgggcggtaaaagcgtggcctggctgtcgtctgaaatcgatgtctggatggctggacgcatcgctgcccgccacgcctaaccccccaataaacgcacccggactcagaacatgcatatccagaaccccaacacccaagaaaccgtcgctttcgccgtcgccggcctgaccgaacgcctggccaccttcgagcaagacctcaacgcctggcagaccctggccgacagcgccgcccgccgcatccaaaccgccgaagctctgcgcaatgaagccgagcagacgcgcaaggactgccgccaggcgatgcgcgcaaccctgggcattcccaccaaggctgtgcgcgagctgaagagcaaggagatggccaatctggaattggccgaggagacgctgaagatcgccgcagaagaaaagattcaggcggaagtgcagcaggaagcgctgttcgagcagcgccaagccctggccaaggagcgcgaggcgctgcgccaccagtattggaacgcggtgctggacgaccaaatcgcccaatgggggcaacagctgccggtgctggcgctgctgctggaccaagcgcccagggcttgcatcgagcggctgttcggccgcgccgagctgcgcagaaatcaagatgagttctatgccgcgcagctgcccggcgagctgcaacaggcgctacaagccgcgccgcaggcggagccggatgaattgctgactctgctcaaccatccgctgccgccgctggctgaacccgcctcgatgcagcacaacccgctggcccgcatgcgctatcaagccgaacgcgacgcgcaataccaagccctgatcaaccgctaagcgagaacaaccccatgcaaaacacgacccgccaagccctggaccacttcatcggccgctatttcagccatatggacgcgcatcaaactcaggacagttgccacgccgccccggagccgcaagctgcgcaggcccgcatcaatgcgctgaagacccatagccggctgctgtccgccatcaacatcctcggcgtggcgaacatcaaaggccgttcgcaaaacttcgacctcgccggcacgctggccgccacggtggacaccaaccgccatgcgtgccagccggcgcaaaagacctggcagccggcgcaatacttctgccggcagaccaacttcgacgcggcgtttgattacgagatgctggacgcctggatgagcgagacgcaagaccaagccctgttcgaggcccgcgcgcggcacacgctggagcgccgcatcttgctggaccgggtgatgatcggcttccgtggcctgatgcgcgccgcagactccgaccgggccaaacatccgcagctgcaagacgtcaatgtcggctggctgcagcaaattcgcgagcaagcgccgaaagcctgcctggagcgcgtgcgcgtcggcgaaggccagcgtttccacaacctgcatcgcctggtgcgccatgcggtcaaccacctgcttgcgccggcctggcgcgacgatccgctgctggtggcgctggtgggcgcggacctgctgccggatgcggtgtgcgagtcaaacggccaagccgcgcccgtcgacgatctggtattccacaagcagcgcctgggcggcctgcaagccgcgacagccgccttcttccccggcgacagcatcctgattacccgcctggacaacctgtcgctgtacttcaaccaaaacgccgtgcgctaccgctatcaggaagaccccgccatcaacagcgtgctgttctaccactccagcgaagatgcctatgtagtcgagaacctggccgcctgcgcgctgattgaagacgtcgagatcgtggactgaggagaccgaagatggcctttccctgcccgctgtgcggcgcggtgtcgagagtgcggaccagccgcatgctgaccgccaccgccaaggagatttactacaactgcagcaatgacgactgctgccaccagtacaagacgatggaaagcgagccgcgtaccgtcgcccagccgatcaagggcggcgcgctgataccgcccgagcggctgcgcgcgctgtctagcttggccaaacccgcgccgccgccagcgctgaccgttacgcccggccggattcagcacaaagtcttgaagtaatgaaaatggcccgctggagggcgggccatttctatcatttggatacaacctttaatttttcacgatgcttggcaagccatcctcttacaccggcatgagatatttccgatgccatttccaattgccgattgatttcatcatcagtcaagtcattatcataagcaatatctaaaaccgcttcatatttttcatgaacagactcaagctccctttttaatcgcttcatttcctgtttgcacgaagaaatactggatcgaataatcaaatccatcagcatgagattacttgcatgaacatacaaatcattagatatctcaccaggggtgaaaagatcgagaatttcgtccgcgcggatattctcatccgagacactccacaacaccttttctattctggtttctgtatgcccgcactctttgcattgcaaaaaatatgctttgtgatacgcgtaaacctcccggcttgtgcggataaacatgatttctttttcacatgccggacatagaacattgcaaacatttggcggaggaaaatcgtggcaagtacgctggtcttttttattaactttcaatgcaatgcctttagaacaaggcccctgccagggcctgtatagaaaacaaaaatcgaatcccacgcaattgtacccatatgaaatgcaccgctcaaacgcaatatgtgaatcacatgcttgacagccccgcacgattcccgcaccattaccgcgtcgtgttcaatagcgcgaccgggtttggcgacctgaacagtaaggcggacagccgccttttgcggctatttttacgtccgtcacacaccattggtgcgtccttttctatggcgggccgtggtggggataccttcgggtatgccggttccttactgccggttcgccaaccctgccatgcgcccgcctcccccgtttggcgacgagggacgggcttaacgctcagtagggaggcacaacatgcccaatatcgccctgcgcactttccgcgccctattccctcaaagtacccgtcccgtttccacgctgcccaacgaggcccaagcccgcgcgctcgccgctttgctggtcgcccaggggcaacgcgccttgattcatcgcaccgccgccggcttcgctgtggaggtgatcgcatgaacgccctgccgctgattgccccgctggcgttgtccgccgtccatcaccaattggcccagctgcaattgctggccaactcgcccgaacacgccgccttgcgcgaccccttgagccagttggccagcttgtgccagggcatcgaacacaccgtcagcgccggcgtgtcgcgcctggcgcgcaccggcgacggtctgcaaggcttggtcgagctgctggattgcgccgaggaccaaccgttgccggcgcagcgcctggccgggctgctggctccgctgcagcagcaagtcatcgacgccagcgccgacatcggccaactgctctaaggagccacccatgcatgctagaaaccctctcccgcgcaccgggcgagacgcccccggcttgtctggcgtcatccaatgggaggcccaatcatgaggctcgatctcgcgcaattgcgtctgcaggcccgcgaccgctggccggacatcctgatggcgctgggcattcctgccgaggtctttacccagcgccgcaaccagccttgcccggcttgcggcggcagcgaccgcttcgaatggatcgacaagggcagcggccgtttcgtctgccgcgccctggatagccagggcggcgacggcttcgtattggcgcaacattggctaggcggcgacttcttccacgcggcgcaagccgtcgcccaggtcttgaacggggcgaagggggagccggcgcgcgtgtcggccgcacccgcgaccacacatccgcaacgagaccaacgcgagcgcctggcgcagctgtggcgcgcggcgcggccagtgaaggctgatgacccggtgggccgctatctgctgcgccgaggcttgagcctgaccgcttacccccgcgcgctgcgctatcacccagccttggcctactggatcaccttgcacggccggccgcagctgctgggccacttccccgccatgctggcgctggtgacgtcgccgcaaggcatcaacgtgggtttgcatcgcacctggctgaccctcgacggccacaaggccgcgctgcgtcaccccgtcagcggcgaagcgctgccggcgaagaaactggccttgggccgttccggcgacctgtccggcgcagccgttcggctctatccgcccacagacggccggctagcgctggccgagggcatcgaaaccgcgctggcggtgcgcgagggcagcgggctgccgtgctgggcggcgctgtcggcctgggggctgtcgcatgcggtattgccggatgaagtgagcgcgctgtttgtgatggccgacaacgacgccaaccaggccggccagaacgccgcccggcgcttggcgcggcggatgcaggaggacggccggcccgtccatctgctgattcccgagcggccggatagcgattggctggatgtgttgaacgaacaaggagaaccgaatgggcagcgctgacaagcaggctttgaagatggccgcgaaggccccggcgctggccatcggcccgcgttatgaagtgaaccgcgatggcgtgcattacatcgccgtcaaacgcgaccgcgataccggcgagctgttggagcagccgccggaatggctcagcgacaagatggagctgctgggctgcgggacggatgcggacgggaaccatcaccgcatcgtcaaatggcagcgccagggcaatggggaagtcatgaccaccgccttgcccagcgccgacatcggcgagcgcgccggctgggcgctgctgcgcaaaggcggcctgacgctgaccaccgaccgcggcggccaggcgcggctggctcactggctgcagcgcgaaggctccaccgagtggcacgacatcgtcaatatgtcgggctggcagcatggcgcgtttgtgctgccgaacggcgacatcatcggccgccccaaccgcaagatgcatttcaacggccggcccaaggatgccagcgcctaccatccggccggcagcctggccgactggcaaagcacggtcggcgcgctggcgctgggcaacccgctggcgatgaccaccatcgcttgcgcgctggccggcccgctcttggccttgtgcggggcgcgggatggcatcggcctgcatctgtacaccaattcctcctcgggcaagagcacctgcgccgataccgccgccagcgtgtggggcgacccgcagcgcaccttgcacacctggtccggcaccgcactagggctgaccaacgaggccgaagccagcaacgacatgatgatctatctggatgaagtcggctccggcgacgcccgcaagatcggcccggccatctacagcatgctgaacggcgtgtccaaactgcaaggcgcgaaggaaggcggcaaccgcgccgcccgttcgtggaagctgaccatgctttccaccggcgaagtggccatgagccagtatctgaccgaaggcggccagacgccgcgcggcgggcaggaaatccgcttgctcgacatcccggccgacaccggcccctatcgcgccttcgaccacatccacggccgcagcaatggcgaagtgttcgccgacgagctgacccgccatgcgcgcagccattacggcacggtcggccgcgccttcgtcgcctggctgcaggacaaccgggcggcggcggtgcagtgggtggagcaatcgcaacagcgcatgctggcggccgtgcccgaaggcgccgcacccacagtccgccgcgcgacgcgcaaattcgccattctgtcggcggcggccgagatggccagtcatgccggcctgaccggatggacggtggaacaggcgattcagggcgtagaaaccacctggcagcgctggatgcaagctttcggcatcgaagaccgcgacgacgcgcgcttgatcgaccaggccgccgccgtgctgcaagccagccagtacgcccgcttcgtattgctgccgatgaatgacagcgacccgctggtccccaacctgatgggctacaagcgctacacgctggaaggcgaagcggtgtttctggtgacgccgggcgcgttcaagggcgaagtcatcgccggctatgaagtgcggcatgcctgcgaagtgctgtaccgggcggggatgctgcaacggccaaaggggggcgcgccggttggaccgtgcatggcggcaaaggcgtgggccaggtctaccgcatgcagttgcatccgcacgacggcgaagcggaagagtaagcgaaaaatttctcacgtgaggccaaacccactgccaacactgccaacacctatctaattaactgatttatatgactttatctgttggcagtgagttggcagtgttggcagtcaattggcagttcacccaccccatcccgcccagttggcagtttgccccctcctgttggcagtgctttagccgccactgccaacaactaaacccatactaatcagccacttaccgacgagttggcagtgttggcagcgttggcagcggtttttgctacatacgtaagaaaataaacaaggcctagtttcgagcgatcagcccctcccttcaggaaggctaccctagtatgattgcagagcgctcttgcaaaccccacggcgaacctacaaatacgactcacgcaaagtgactaaaaacgattgtgcttgcatagttaatttccgtcagaattaaccagcagcaagaaatggtctacatcgacttgacaatcgtttcattgcactaatcacacagaaaataggtataaatgaagactgctagtgctgccgtatcacacgaacaatctttatctctaggttgccaaaaaactgtgtataggcgaattagttatttatgacatttcatcttgtagcagatcacctttcttccgaagctggaaaaaaaacaggaactcctcctgctgatgcatttgcacgcaccgcattcaatcggtactattatgcggtttatttggcagtgcgcgaatttattggcgaattcgaaacggattggaaacgtactacccatgctaaagttcctgagattgtcgaatttaatcttgccaagaaaataaaaagagaagctgacaagctgaagaaacacaattcgttatcggaatcagaatattccagaataattagaatatcaagagacgcgacaaaagatatcgccggaataatgaaatccgcctatagcataagatgcatatctgactatgagccggaggttccgatagaattttccaattctcaattttcaatcaagagcactagtagcgcagaagctaagaattgggaacgtagaattcaggagaggataggtcagattaagaaaataaccaaggaggtaggccttgattaatgaagagacaataaaagaacaccttgggcagtttgtcgacatcattactgaaatccgagtcgacgaacagaataaaattattttactggatttatttgataataacgtatcaaataaaagggagcataattccatatcaccagggcagattgaatttctaaaacgtaagctgagaaaattattcgactttcgcgttgaggtggttttgaaacagtccgaattatcgactcagatagaggaggacattaggtatgaggtcaagaaaaaatacccgaatcttgtagaaagcgtaagcctttcatttaagacttcaacggatgcgtacgttatagtatttcctgcagcacaactaagcaaagatgcatgcgaagacattgagaggcatattaaagcccagcttgaattagttgaggtaaaaagcgtaggctttgattttgttttaaataaatggcttgagccaagcaatattcagatattaaggttggtgaaaattactgcgccagttacattggacaaccttatggctcgtatcaacggacaaaacttgtattgcccatcagaacgatggttagcctccaagctcgatctgttgcgaaaaaagagactcgttgtacgcctggaaaatggtacctatgccctatctgcacgcggactgctagtaacaccatacggcacagataggaagagttcagacgtggagcgaatgttgtttcttggaaaagttcatgtatgatagaatccttacgtggtggtgtagtcgtgtgggtgtgtatcatgcccatgagtgacgaccgggcacagaagtgcagcctgtctaacggcagctgctccttcgaatcagctgccgttagacaggctacattgacgaaagtatctttttagactttgctaccttgaacacaccaccactcccccttcttgttactttttcgtcacttccagacctcctcttagctctacagcttgaggaagaggatcatgaacgaaaaacgcagatcgaagctcttcacaggaagagtttgccaccggtgacctcaactttggcgttgagcactatgtttggtatcagcctcaactttattcatgctttagcccggcaccctgagaaaaattacagaaaattcaagattcgaaagggcaaaaaaaatcgtgaaattagctctccacgcattgcactgaagctaattcaacggtggtttgctcaacatgcttctagcgcattggtatttcctgagtatgtttgtggcttcgtccccggaatcaatggcgtcaccgaagcagcaaaaagacactgtaatgcgaaatgggttttctccgttgatctccgtgacttcttcggccaagtgtcgagggcacgaattcacaacaaactagttgccttaggttatcctgaatcaggagctgacctaatatgccaactttgtttgttagatgacaagctacctcaaggttctcctgccagtccatttttatcgaatttggcttttcaagaaacagatgagaaactgaatttaatagcctctaaatttaaatgtcggtttagtagatatgccgatgatattgttttttctgggaaaaatgaattcgatccaataatagaaaaagaggtcaaagaattactcgagcaagagcgctgggtacttgccgaagataaaacagaaatatcccagctccctcatcgtctgaaagtgcatggactattagtgcatggagataagcctaggttgactaaagggtatcgaaatcgtattcgtgcgtacaaacatcttctgagtaatgaaagaattcgtgcggatgatataaataaagtaaaatctcacatttcgtacgcaaatatcattgattctatttgaattagccatgtactccatctggctttgttgcgcaaatccatcctcgcacgacttgataagatatcagcatgaaggcgatggcaaacaattcaatggggctaaacgtaaacgaacacagatctatggtgaggccgccattcaattctgcgttatcatcaagagcctgtttagactgaaagcaaaccatcggtttcatacaaagcctactcaatgacaggcttcggctggagaccactcctagtctcagagttagcaaacgctaaaaatcagcattccctatcaaaagtactctaacgcgttgcatctgtcagtcgatacacggtatcaaacttgaaccgtttcagtatgctggcccgtccatgtacgatagctgtgacataaatctgtttggtgagaagggaaactatccttacccaagacttatgcaacagcgccatccggccgagctgactttgaccaaagacgcatcaatgttggtacatttgttggtatttaattttcaaaataaaaaatacttcaataatttcaatgcattgattgatgttttcgagagtgactctgtcctcgatgtttgcgcagggcgagtccagcctcgcctcgggcctgacggcccccacgggcgcccaaagccagactaggatatttggcggtggcacatccgggtaaatatccctccctgccgccgggcagtcccggctatgaaaatcatcatccgcgcagcggactctacgtactgcctcaaagcacagccctattcctgccccaactgcttgcctggcaagccttccagccggataatctcaatcgtgccgttcaatagcggcaccgggattggcgtcccgcattcaggcggacttctgtgcaaggctgggccttgtcgcgtccgtacaccattgcacgtcctctatggcgggccatggtgggagcatctatgatgcgccgctcctggatcggtacgccaatcccgccatgtgcctgccacccctacttggcgttggggttggcagggttaagcacctatccaggagggttttgccatgccttgcatcacccgcagtccgtcgcacctcgcgctttccctgaagaaccgtcatcccgcccgcagccgctggctgctgcacaaccaagcccccacgcatccgcccagcctgctggcgatgacccggctgcacgaagcctttgccgccttgcaggcgcaattggccagccaggatcaatccatggttagagagccggccgcgcgcgtcgcgcatttgtgccacgacatcgagcaggcggtagtggagtccatctgccacctgtcccatggccagttgggcttgcaatccgtgatcgatttgctggcttgcctgggagatgacgtgcgcctgccatctagccgcatcacggagttgctgtcgccgctggacaagcgcatgaatgagtcgctgacgctgcttacccgcgtgctctaaaccccgcctcgtaaacacaacagccagcccgcttcaatgggctggctgttttggttttggcgatgcttggagacggcgcaatgcccggcgggaaaggcggctgcatcgacaggtttctagccgggtattgcaccctacggtgcggaagccgtcacgatctttagagccaggatgcaacgccgccatggtgtgaacaggtgcctctgcgatgcgtgctgaagctgtaggtgccgtcgccgcaccgggcggatgcgccggccggagccttgccggttttcgaatgcgccgggctatgcacggtctgtccatccgagttttggtaactgccatgctctagcaattgggactcgttaggcttgtcgctataggactggctgggcttcttggcgaaaacaggctgaaatgccaatgctgcggcgagggcgaggatggcgaggcgcatgcaatttccttttctgctcgagaaatgtcaagtgcattttacgtatttctaccagctctcgcatacaggattctgacgctgcgctgcctggccgggcgcgatacccggcctctgccgaatccatacgccgggcatgagggcgattggcggtacgaaacagccgcgctttggttttgcgacatggcggacggcgtcatgcccaccgcgaaggcagccgcagcggcgtgtttctggccaggctatgccctgcgctgctgacggttttggatttggcgatcgtgaaaagcggcgcaatgcccggcgggaaaggcggcggcatcggcgggtttctagccgggtattgcaccctaacactctgtggaaaatcacactctcagtggaagcatcaatcactgtgcttgaaagttttctcggtaaacatcgggcttcctgttactcatcccaacctaccccccttccccgcgcagatcgcaagcgcgctggcgaacatgacgggctcctggcagatcgggcgatatttggcgggtctccggcgccaggtgttgaccaatgcgacccgactaggggaggacgaattggaagaaggtcatgatggcttgatatgtgactgaaaagggcggctgttgccgccctttgttactggttggtctgatacgcttttaaaatctgaagcccatgggcttgggcgcggacttgatcatatcggccaatcatcttgctgttctctatcaagctttgcacaccagaaaacagatcgaaacgggcaggctgcgaatatcccaactgctcgttgatatcgcgaagcataacagtgggcgagatggtctgatattcctcaagactcagcgttccattcctgagcatgccaatcaacaagtccgatgcttgctcggtcgtaagattggagagatcaaccttgccggatgctgtggaggtttgtgttgcgacatcggacttggcttgctccagtacctgggaaaagtttgatgcccttccactcgcaacctgctgttggggcattgcagcttgtttttcagacgctgaagggatgagcattcttcctccttcgtatttttggacttggtgatacaccacaacggtgcaatgcccggctgaaaggcagctacagcgacacatttctgccaggtcttgcaccctacccacgttaacgccccatcttgcgcagcgccgccgcccgcgcctcgaactgagcgaagcgctggtccagccgctgccgttgccgcgccttgtccgccgggctgaggaaagaatagcggatgctgttgtagacggtgcgcttcagttcgtcgtacgagggctggtagcggctgacgtacagcaggtattcattgctgatgtcgctgcgcgacacgccttcatcgtcggtggagatcacgaacggcacgccgtacttgcggtacagcaggatgggatgcgcggcgccctgcacgcccaggatgaactggttgctggtgaggttgatttccaccgccacgtcgcggcggcgcatttcgttcagcaggctgtccggccggctttcatggccgacgtctatgccgtggcctatccgctgcgcgccggccagctccaccgccagccggatatggtcgcgcaggccctccggcggcaccatgcccagcaccagctcgccggcgtgcagcgccaacttcacatcgggaaagcgctgcttgaggaaatggatcatgcgcatgtgcagcgcgtaatcgcgcatcgccacaatgccgttttccgggccgacgatgttcagccccaccaccagcgggttgtcgtgcgcggcggcgaagccggcgtacagcccggcgaaggtgatggatggcttgttattgcgcgagacataggtctggaagcgcagcgtgaagtcgtcgtcgtccatgccctgggcgaagccggccagatcctgccggtaacgctggacttgctcggcggtggaggcgtccgccgccagcgccgatgcggcctggcccagcgcctgctcgatggcggccggagcggcgtccggggccaggctgtccagattggcggccagcgcgctgttgccggacggcgcgccgcgcagcatggtttccaggtattgcaggttttccgccttggcccgggttttcagcagctgcaggccttcgcgcggcgaatagccggaaacgccgccgaaatagccgaaggtatcgaaaaactgcttgtccggcggcggctggtcatggctgtggttgtcgaaatccttgtccgaccacagcgtcagcagcttgcggtacagcgcgttgtcgtccttgatctggctgccgctcaggcacgccgcgcccggctgcgcctgctccggcttggtttctattctcagcgtggcctgatagacgcagtacttctgcctgtccacccagtccagataggtttcggcgtacagcgcgccggtgtagtggtgatgcagatcgccgcccttgggcagcatgttcatcagcatgcccagttcggccacccgtcccttgtcggccagcagctgctggtaataagcgcgcgccgcctggtaattcgtcttttgctgcgccgcgcccagcggcgcttccgcccgcgcgcccagcggcagcagcgccagcgacagttgcaggcaggccaaagccagtatcgatttcacattcgctcccattcgcattttgacgacggcataaccgtaacagcagcgcagggaaaccggaaggatggcggcgtggcagcatggccagctggacaaaggccaagcggccagacaagaagcgtaccagccgtaacaaaaaataacgaaaacagctatttaggccagctataaaagaccgatataaggcacaagcagtcccgatcatctcaccatggagcgatgcatagcggcaaactcaggcgaaccttccgatcccgcactttgattggttgcgccgcgccacaccgccatccgcagcacccaccagaccgctattccggccaggactccggcaacggtcacactgcgagacgacaggcggcagcgacgccagattgccagcgctctgcgcgacaacatcaactcaggccatcccagcaggatggcctttgttatggccaggcgggccatgccccgcgggttttaccaaacttttaccgtttgcgccggcactcggcggccggcggcggtctattcctgtttcgccatcttgcgcaggaaagccgccacatgctgcaaaactacttccccatcctgttgttcattctgatcggcctgctggtcggcgtcgtgccgctgctgctgggcaagctgctgggccccaaccggccggatgcggaaaaattgtcgccgtacgaatgcggctttgccgcgtttgaggacgcgcggatgcgcttcgacgtccgctactacctggtggccatcctgttcatcctgttcgatctggaagtggccttcatgattccgtgggcggtgacgctgaaagacgggctgggcctgttcggcctgggcgcgatggcggtgttcctcgccatcctcaccgtgggctttgtctacgaatggaaaaagggcgcgctcaattgggattgagcgcgccaaagaggccatccggggcgggatggcctggagcccggtttatcaggccagcaggtggcccaggaaggcgtaggccaggccgaagtagatgaacacgcccagcatgtccatgatggaggtgatcagcggcgagctgagcgtggccgggtcggtgcccaggcgcttggccaggaagggcagcatcgcgccgatcacgccgccggccagcgtgcacagcatcatgctcaggcccaccaccagcaggatgtcggcgccgacgcccttgctgaagtgcgacagcaccatgtccagcagcgccaccgccacgcccagcgccgccgccaccggcagttcgcgccggatgacgaaggcgacgtcgcgccagttcagcttgagctggcccagcgccatcgagcggatcaccagcgtggccgactggctgccggcgttgccgcccatgtcgacgatgggcgcgatgaaggcggccagaatcaccacattgctcagcagctcttcctgctgggcgacgaaggtgctggtgatggcgccgaacaccgtcaggatcagcagccagaacacccgcaccgagaacatgcgacggacgctggaatgcaccacgtccagattgcccttgtccagcggcgcggcgccgccgaagctggccagccggccggtgtcgtcctcgcgctcgatgtccatcgcgtcgtcgatggtgacgatgcctatcatccgctgcgcctcgtccagcaccggcagcgccagcagctcgtaatggcggatcaggtcggcggcgcggtggcgcgcccagccggcctcggcgtaggccggattgtgctgcatcagctcggccacgctggtttccagcggcgccagcaccagctcgcgcagcggcagcgtgcccagcagctggtgctcgtggccgacgatgtagatcacctcgatctgctgccggtcgccggcgcgcagcgcggccatcgcctccgccgcggtcagctgcggcgagatggcggcgtagtcggaactggtgaccgaacccaccgtatcctcgccatagctggccagcttgaggatgtcgtcgcgcaccatccgccccagcgccggcagcagccggctttgctcgttctggctcagccgcttgtagaggtcggcgcgcaggtcagacggcaggcgctcgaacaccgccaccaccgccggctgcggcagccgctgcagcagctcgtcctgctgctcggccggcaacagcgccagcacgtcggcggccagcttgggccgcatcgcctgcagcaagcgcgacaccgcctccggcggatgggccgccagcgcctccaccacgtcggccagcggcagcgcgcgggtcagccggtcgaaagcctggtcgtcaaaagcgcgcagctgggcgcggatcgatacttgcagttgttcctggttcatcgcttggtcctgtgcgaatgtccgcggcgcggccgataacaccggcgcgccgggggaagaaatgcttgccgcaatgaatgcaggcgcgacaagccgcatcgcctattcgcgctggcgatgtttatttcttccgcaatattgaatacggggtggttttatcagtcggcgcgccaattaaaaatccatgcctggccattgaatggaaattcaaaatcagccatgcatcaggcattgcgcaaactgaatgggcggggtcggccgggcgctgcgccggccgctgaaaaggcgggatcaggcggctgggcgcgcgggccgacacggtcgaggttctggctcttctggcatcgctgcctccgtgtggcgtagaaatgaaaccctgccgcgggcgctgcgcccggggcgagggaaattatttaatgttcaggaacaacgagataacaacacaagacaggcgcagtgaggcctggacgcgtcgccgccgctggggcggaatcgggaagggcgcgagttggccgatggccaagggcaaccgcatcctggctttgcaggatgcggcagaagaaatcagttctgcgggatccggcaaagcggcgtggcgatcgaagatcgactactgccgtcgttgttcacgatgaacctttgctttgtggataatggcgcaaactataaaccagctattaattcgaatcaaactttgtaatggtggttttacatttctcttatttaatgggcggatattatatgccccctctttattcagccatgccatggcgatgaggctcgccatttttcatatccattctttatttcaaataaataaccatacgccgcaaacttgccgctcgccatgctcggcaagcggaaaatcaactgtcattccgctgtgatatcatggcgccacaccactacaagccatgtccgaatggcacacgctccgtgaaacccatcgctcgcgccaaccttatcctgatggcggccgccctgctgtcgttcgcctgcgcgccgcttcgcgccgccgacgctagcgacgccgcccatgccgccaaccgccccgccgcggtgttcaaccacggcgtggcggtgttcgagcagcagcgcgagctggcgccgcgcgccagcctgcgctttcgcgtgctgcacggcggcggcggcgcgttgacgctgtggctgaaaagcccggccggccagatgcccttgccgctgacgccggactccaccttcaaccccaccgcgctgtccgacggccaaagcatcgtggcggcgccggacaaccatgccgggccgctggcctggcggccggacatccgcagccccggcctgccgccgcacagccgccggctgggcgatttgaggctggaatgcctggtggaccagcaaagcggcctcaatccgcaggagccgcgcgccaattgcctgccgccggcgcgccaggccgactgcctggaacagatgggcgattgcctgcgcggcgcctcgctggccctgctggcgcaatggcacgcgatgcaccggctgcaatgggcccgcgccaccggccagccgcagccggcgcgctacctgttcatcgccaagcatccgctggccgccatccagctggcgcacggcgagcataggctgacgctgccagccggctggctgcacggcggcggcgcgcaaaacggcgctccctggccatacccgcgcgaatacctgtattcgctgccgctggacgcggtcgagtggccggacgacacgctggtgaccttcggcgacgccgccaaatcctgacgcggcgtggacgcgccgatacagtcaatacgcggataattgtgtaacattcagcatcatccccccgcagcccgcgccatgatcgtccgcaacacctcttcctggttccgtctgctgttcgtctggcacggttcggtgctgccgcgcatcctgccgcggttgctgctggttttcgcgctggccatcctcgcctcctccatccgccactggtggctgaccagcctggccgattcggcgctgagcatccccaccttcacactgctgggggtgtcgctggccatcttcctgggctttcgcaattcggtgagttacgaccgcttctgggaagcgcgcaagctgtggggcagcctggtgatcgccagccgctcgctggcgcggcagatgatttcgctgaccggcgccgggccggacagccggcgcgtggccgacggctgctgcgccttcgcctacgccttgaaggaacaggtgcgcggccagcaggacgacgcgccgctggaaaggctgctgccggccgacgtgttccagcgggtgcgcgccggccgctatcgcccggctttgattctgctgtggctgggcgaggaagccgcccgcctgcagcgcgaaggcgcgctcagcgagcggcaatggcaggcgctggaccgcagcctgaatacgctgtcggaagtgctgggcggctgcgagcgcatcgccaccacgcccattcccttcacctaccgagtgctgctcaaccgcaccgtcaccctgtactgcctgctgctgccggcggggctggtcagcagcataggctggctgacgccgccgatcgcggtgttcatctcctacacctatttcgcgctggagcagatcgcggaagagctggaagacccgttcggcttcgaaggcaacgacctgccgctggccgcgctgtgccacggcatcgagtcgtcgctgcgcgagatgcaaggcctgccgctgctggacgagcctgccccgcgccagggcatttacctgcagtaagccggtcagcgcaggcgttcgcgcaccgtttcctcgcgcagcagcaagtggctattggccagcagatcggccagcgacacgatgccgaccagccgcatgctgtccgggccgtccaccaccggcagccggccgacgcccaattgcgccatccgcccggccgcgtggcgcgcgctcatgccggccagcagcgcctgatcgccggatagcggctccgcccacaccacgcagggctggcggctggccgccgcctcctgcagccgccggcgcagcagcacccccaccaccttgccgtcgcgcagcaccggatagccgttatggccgcgcgggccgaagaattggcgccaggcgtccgccgccggcagcgcgccgtctatcgccaccgccgcgcgcgtcatcacgtcggccacgttcagccgctccaaggggtcgacgctgtactcgcggtggatgtgcagaccgcggcgggcgatcttctcggtcatgatcgaccgtttcagcgccagcgccgtcaccgcgcaggcgacggcggtggtcagcgtcagcggcaacagcgccgtggcgtcgccggtcaggccgaaggcgaacacgatggcggcgagcggcgcgcccagcacgctgcccaatacccccgccatgcaggccagcgcccataattccggcgaaccgcccggcaaggccggcgccagcgccgcgcccaggccggcccccagcatcagcaagggcgccagcacgccgcccgaggtgcccgagcccagcgccagcagccagatcacggctttcaccgccaacagcgccagcagcgcgcccagcagcagccggttgtgcagcaggtcgccgatcacgtcgtagcccacccccagcgcgcgcggctgcagcctgccgccgatgccgaccgccagcccgcccagcgccggccaccacatccagtgcaggcgcagcttgccgaagccgtcctccacccggtacagcccccaggtcagcaaggccgccagggcgccgcaggccaggccggccaacaggcaggagcccagcgccgccagcgtggccggcggcgtgctcagcggaaacagcggcccggcggcgaagcacagcccgcgcagaaagccggcgcaggcgcaagccagcgccaccggcagcaggctgcgcggccgcagttcgaacagcagcagcaccgccgccaccggcgtgccgaacacggcggtcatgccggcgcaggcgccggccaccagcagcgtcttgcgctccgccgcggtcaggtgcaggcgctgcgccagcagcgagcccaaggagccgccggtcatgatgatggggccttcggcgccgaacggcccgccgctgccgatgacgatgccggacgacaagggcttgagcagcgccaccttgggcgacatccggctctggccgaacaggatggcctccatcgcctccggaatgccgtggccgcggatcttgtcgctgccgtagcgcgcgatcaagcccaccagcagcccgcccgccaccggcgcggcgatggcccaggcacccagcgcgtggccggccggcccgcgatcggccagcgacagcgtctggtaatagaacagattggtgcacagccggatcaggtccagcagcgccgccgccgccagcgtgctgaccgcgccggccagcaaggccagtccggacagcaacagcagccgccggtccaccgaataatcgcgccgcgccgcgctcatttgccgccgtccccgtcgttgaaggcggtgatgcgcgacacccggaacacgtcgcgcagcgagcgcagctccgcctcgtgccgcgccgccagccgcgcgagatggccttcgccggccgcggtcagatgcacctccacctggcggcggtcgtgctcgctcttgcgccgcgccaccaggcccagttcctcgcagcgggtcagcagcgccaccgcgccgtgatgcaggatctgcagccgctcggccagttcgcccaccgtcgcccaatcgcgccccggcaccccgcgcacatgcagcaatagcaggtattgctgcggcgtcagtccctcgcttttggccgcctcttcgctgaaatgcaggaagcggcgcagctgatagcggaattccgacaaggcctcgtattgctgcttgcccatgccgacagccggcgcggcggtgtgttccatggcgtttccacgctccacatatatcataatatgatatttatacccgaccgcgccttagcctgcaatatgcatcacaatatgatatatatgccggtcacggccgcaaacggcatggaaccacaccacgatgcgacatctgaaacgacactgcggcgactggctgcgcggcttctggccgcaagccatcgcagccagcccgcgtgaccggctggccggcagcctgggcgcggctttcggcctgatcgccgccgcctggctcagccgccacgcgctgggcgaagccaatccctggttcatcgcgccgatgggcgcgtcggcggtgctgctgttcgcggtgccggccagcccgctagcccagccctggtccatcatcggcggcaatctgtgcgcgtcgctggtgggggtgagctgcgcgcggctgatcggcgacccggcgctggccgccggcgcagccgccgccctcgccatcgcgctgatgttcccgctgcgctgcctgcatccgcccagcggcgcggtggcgctgaccgcggtgctgggcggcccggcggtggccaggctgggctacggcttcgtctggcatcctgtgctgctcaattcgctgctgctggccgcggcggcgctgctgttcaaccgcctggccggccgccgttacccgcataaccagtccgcggcgcccacccccagcgagcgcgtcggcgtcagccgcgccgacctgcacgccgcgctggcggagcgcggcgaagtggtggacgtcagcgaggacgatctggaggacatcctgcagcgcgcggaggaaaggctgcaccagcgccgcttcggcgcgctgcgctgcgccgacttcatggcgcgcgaggtgctgagcgtaggcgccgacgcccgctgcgccgacgcgctggctttgctgcgagcccaccgtttcgaagcgctgccggtcaccgcgtccgacggcaggctgctgggcgaaatcaccctgcgcgggctgctggccgaagccgtccgtcccgacgcccgcgtcgggcaatggatggacccgcgtccgcacacctcaagcccggacgacccgatcgagcggctgatccacccgttcgccgaccgcggcgtggcgcgcagcatggtggtggacgccgatggccggctgctgggcctggtgggccagggcgacctgatcgccgcgctgttccgcgagcaactggagcggccggtctgaacgcctatcggctataccgaaatctgccggacgccatcgcgccgctggccatgacaatggcctttgcatagaatgtgcactctcaaaccgccgcgccgccaagacccgcccatgagcctgccccgcctgctgttttccttcgtcctgcgccatctgcgcccctactgtctggccgcgctgatgctggcggcggtggcggcgctgaccgtgatgatcccgcgcgaagtcggccgcatcgtcgacgcgctggtggcgcaccggctggccggcggcgatctgctgcgggagctggccaagctgctggccatgggcctggccatctattttctgcgcgtgggctggcggctgcagctgttttccacctcctaccagttgggcgtggagctgcgcacccggctgtaccgccagctgtcgcgccaggggccggcgtttttccagcgccagcgcaccggcgacctgatggcgcgcgccaccaatgacatcgattcggtggaaatggccgccggcgaggcgatactggccggcttcgacggcctgctgaccctggtgctggtgctggcgatgatgacgctgagcgtggattggcggctggcgctggcggccttgctgcccttccccttcatggcctgggctttctcccgcatttccaaccacatccaccgcgaatggggcgaggcgctgtcgcgcttcggtcggctgaacgaccacgtgcaggaaacattgagcggcgtgcgcacgctgcgctcgctggggctggaggcgcgcaacgacgccgaattgtcgcggctggccgccgccgccgccgacagcagtttcgaagcgcagcgctgggaggcggcgttcgagccggctgtcggcgtgtcgctggtcagcgcctcggtcatcgcgctgtcggtcggcggctacctggtatggcatggccagctgaccataggcgcgctgaccagcttcaatatgtatctggtacagctgatctggccgatgttcgccgccggctgggtgctgtcgctgctgcagcgcggctcggccgcctggcagcggctgcagccggcgctggaggccgagccggacgtggccgacgccggcggccgcgccgagctcgtccccggcgcgctgcatttcgacagtctgaccttccattacgcgcccgaggccgccgccgcgctgagccaggtttcgatcgacctgccgccggggcgcacgctgggggtggtcggccccaccggcagcggcaagtccacgctgctgaagctgttgctgcggcaatacccgctgcagcagggcgccatccgctgggacggcgccgacatcgccgactaccggctggccgccttgcgcgccgccatcagctgggtgccgcaagaggcctttctgttttccgccagcgtggcggaaaacatcgcgctggcgcggcccgacgccagccaggccgacatcgagcgcgtggcgcgcctggcggcggtgcacgacgacatcctgcgcctgccccagggctacgccaccccggtgggcgaaaagggcgtggcgctgtccggcggccagcgccagcgcgtcgccatcgcccgcgcgctgctggccgacgcgccgctattgctactggacgacgccttgtcggcggtggacacccaaaccgagacgcaaatcctgcagcacctgcgcgaagcgcggcgcggccgcagcgtgatcatcgtcagccaccggctgtcggcggtggccgacgccgaccacatcgtggcgctgcaccacggccgcatcgccgaacaaggcagccacgagcaactgctgcaacgcgacggctggtacgccagccaatggcgctatcaacaactggaggccagcctggatgaaatctgacgccacccgcacccaaagccgcgaggccgtcgccctgctgaccgacgccgcccgccccgacctgcgccatctgtggctgggcggcggctggctgctgatcgccgccctgctggaagcggccgcgccgctgctgggcaagatcttcatcgacagctacctgctgccgcaccggctggaatggtcgcccgtcgtcggcctgctggccggcagcctggcgctgggcgtcatcgccgccgtgctgcgctaccggcagctggtgcggctggccggcgtggccatgcgcgcggtgctgcgcctgcgcgagcgggtgtacggccatgtgatccggctgccgatggccttcttcgaccaggccatcaccggccagctggtcagccgcgtcaccaacgacaccgagtcggtcaaagcgctgtacgtgcaggcgctgttcgtcatcctcaacagcagcatcgtggtgctgggcgcgctggcggcgatggcctggctggactggcggctgatgctggtgacgctgctgctgttcccggccactttcttcatcgtctggctgtaccagcggctgagcgcgccgtcggtggcgcgcgcccgcgcgctgcgcagcgacatcaacgcgcagatggcggaatcgatagccggcatcgccgtgctgcaggccagcaacgccgagagccgcttcgtctcccgcttcgacgacaccaaccagcgttattaccaggcgcggctgcgcgaattgaacgccaacgcctggctgctgcgcccggcgctggacctgttgaacgtgctgctgttgatcgcggtgatctacagctacggccagcgcgagctgggcggggtggaaatcggcgtgctgtacgccttcgtcggctacatcggccgggtggtggagccgctgatccagatcaccttgcagttcggccagctgcaacaggcggtggtggcggccagccgcgtcagccacctgctgcgggaaaccgccgcgccgcagtcggccgccgacggcgccatcgccgccggcgcggtcagcttccgcggcctgcgcttcggctaccagccggaacacccggtgctgcacgagctgagcctggagattccggccggcggcttcgtcggcatcgtcggccacaccggcagcggcaaatcgacgctgctgtcgctgctgctgcgcttctaccggccgcagcaggggcaaatcctgatcgacggccagccgctggacgatatcggcgacgccgccttccgcgccggcgtcggcctggtgccgcaagacccgttcctgctggccgccagcgcccgcgaaaacatcgacatgggccgcaacctgccgcagagcgaaatcgaggaagccgcccgcgccgccggcgtgcacgagctgatcctgtcgctggagaacggctacgacagcgatatgggcgagagcggggcgcggctgtccagcggccagaagcagctgatcgccatcgcccgcgcgctggccggcaagccgcgcatcctgctgctggacgaggccacctcgcacatcgacagcgagaccgagcgactggtgcagcaggcgctggccaagctggccggcaagatcacgctgatctccatcgcccaccgcctgtccaccatccgcgacgccgacgccatcatcgtgctgaaccacggccgcatcgccgaaaccggcgaccacgagcagctgatgcagctgggcggcatctaccagcggctgtacctgctgcagcagatgcagaccgaggacgaggcgtgagcctggatgcgtgcgcggccatccgcgccgaggtggccgccattacgccgctggacgcgctggaggcccaacaccgccaggccgcgctggattggatagactccggcgcggaattgtggcggcgagcgaagccggccacgccgctggtgcatttgtcgacctatttcgcgctgaaggacgatgccggcctgctgctggtggaccatcgcatcgccggcttgtggctgcccgccggcggccacgccgagcccggcgagcacccgcgcgatacggtggtccgcgagctgttcgaagaactgggcgtgaaaggcttgccggtgccagccgcctcgtttctcacttgcaccaaagtcgccggcggccataccgatgtgacgctatggtatgcgctgccgatttcgcgctccctgccgctgcgccatggccaggaagaattccgcgaagcgcgctggtttgatttcgaccagatgcctcccgccagcgagccgcatctcgcgcgctttgccgccaaactggctaagatagacgcctgaacgcgggccctggccctttcacactaccggagcccccatgtcccgcctgcacttcctcgccagcctgctcttgctgtcgctggcctccctctcctgccgcgccgacgacggcaaggacctcgacctgtcgatcagcaccgagctgatgacccggcagaccgcttacggcaattcctcgcggctgcagcccagcgtggacatgcagtaccgcacccgcttcggcgccttgtacatccaggatggcgaaggcggctgggcgctgccggcgccggccggctgggtgtcgctgggcgtggccagcgagccggcctggagcctgggcggcggcgtgtcgcagagcctggccatcgcccgctacggcttcgacctgccgcgcgacggcagcctgtccttcggctacgccagccgcatcggcgacagtcaccccggccaactgctggtggccagcctggacgcgccgctgggcgattggcgcgggcaaaaattctcggtgctgggctgggccagcctggccaaccaggagcgccggctgggtttgaatcaccatgacgacggcgccggctggcagctggagcaaagcaatctgatgctggtgatgtcgcacccgctctcccgccactggacgctggacctgggcgccggcagccgctgggcggcggaaaacaccggcagccataccgccggctggcagacgctgctgggtttcacctggaaactgtgatgcgcttcgatccgctgccgccggaggactgcctgatagacagccactgccacctggacgcgccggagctggcggcggacgtggacggcgtggtggcgcgcgcgcgcgcggccggcgtcggccaactgctggtgccggcggtgacggccggcactttcgccgacgtgctggcgatgcgcgaacgctacggctgctggatcgccttcggcctgcaccccatctatctggaccagcatctggacgagcacttggcgctgctggacgccgcgctggcagagcacgcgccggtcgccgtcggcgagatcggactggatttctacttgcccgagctggagccggcgcggcaggaaaaactcttggtcgagcaattgaagctggcgcgcaagcacggcctgccggtggtgctgcacgtgcggcgctcggtggaccgggtgctgaaacacctgcgcgaacagaaggtggaatgcggcatcgcccacgccttcaacggcagcgaacaacaggcgcaggccttcatccgccagggcttcaagctgggcttcggcggcgcgatgacctacagcggctcgcgccgcatccgcgcgctggccgccaccctgccgctctccagcctggcattggaaaccgacgcgcccgacatccggccggaatacgcgcaggacacgccgaacgagccgttccagctggcccgcttcgtcgaggtgctggccgaattgcgcggcatggcggccgcgccgctgcggcgggcgctgcgcgaaaacaccctggcggcgctggccttgcgctgagcgccggcccagcgaaaagccccggacctgccggggcttttttgcgacgggcgcagccgcggccgctcaggtgcggaaacgctgcaggcagccgtccagttcgtgcgacagcgtctgcagccgcgacgccagcgtgctggcttcgccggcggcctggttggtctggccgttcatctgcgcgatctgctcgacgttgcgcgccacttcctggctggcgtggctttgctcggtgatggcgctggcgatgtcggtgatgcgctccaccgaatgctcggccagctcgcggatctggcccagcgcgtctgcgacgctggaggcgctgaccacgccggtttcgatgcggctgttggcctgctgcatgctctggtaggcgcgctgggtatcggccagcacgccgtcgatatggctggagatctcggtggtggcctggctggtgcgttcggccagcttgcgcacttcgtcggcgacgacggcgaagccgcgccccatctcgccggcgcgcgccgcctcgatcgccgcgttcagcgccaacagattggtctggtcggcgatgtcgtggatcacccgcacgatgtcgccgatatcggccgagcgctggttcaggccttccatcaccgcggcggtttcggtgatgctgctggcgatctggcggatttcgccggccgccttctgcgccagctcgttgcccgccgacgcctgctccatcgtcaggcgcgcctggcgctccacgtcctgggtgctgtctgccaccagattgatgctgaccgacatctgctcgatcgccgcggcgccgctggcggcggcctcggattgccgcgccgacgccgacgacacgtgctcgctgacctggctgagctggccggcggcctgggccaggctggtcgagtggccctgcgactccaccaccaccgcccgcaccgtgtccaccagtttggtcagcgagccggcgacgttgcccagctcgttctggccgaaatcgggcagttgcagcctgaggttgcgctggtcggccagctcatggctgctatcgcgcatctgcagcagcggctggcggatggaggcgatgatgatccaggccaccagcgcgccggccgccagcgccacggcgatttccaccagcagctggttgcgcacgctggcggcggtggcgtcgatctggtcgtccagctggcccaccgcatcggccgccaccttgcccagcgcctcgctgacgctttccatctgatggatgttgtccttgtactgatccagctgcttgttggcgtcggcggtggcggtgacctgcttgccttccaccatgccggacaccttgccgacgccgtcggcgtagccggccagcagcgtcgacagcttgttcagctgctgagcggcgtcgtcgttgagcggatggccgccggcctgctggatggccttctgcgcgcccgcctgcgcgctcttccacttgcccaggtattcggcgcgcttggcgtcgtcggcgatattgatgaagtagtctttttcgaagcggcgcagattgcccatattgcgctgcaattcgacgatgtccgtgtagaacagcaggtcatgcgagctgacctcctccacccgcttggagatcttgttcagacccagctgggtcagacaaccggtcaagatcagggccgccaacaatagcccgaagcccagggtgatcctggccgcgatagacaaattccgcatggtatttccccatacccgatgagattgaacctggccgggctgagcccgatccgttttagtgctgcgattctagttgacgactgtcgttacaaaccagttacaacatccccaacggttaaattcacgccgtcgcagtatcaaaaagctcaaaaaaaagccggcagcatgggccgccggctttttcgcgcgcgtgtcgcagctcaagctctgcgcttgaagctcctggcaaatcccaatacacagataaagaatagtgtactaagcagaacttcacccaaggcaaagcgtccggcgaggccggggtccgcccagccgcgcatcaccccttcgctgaaaaaagccaggatgaacatgctggaccattgataggtatagagccggccggccaggatgccgcgcagcggcagcaacagcagcaaggccttgaacgccaggaaggagccgcccggacgcagcggcgccagcgacagctcccaggccagcgtcagcaggatcagcgcgatcagcgccgccgacgcgccgcggcggaagaagtcgcggctcatggcgccgattcggcctgttcgcgcgcgcgcgccttgcgctccatcagcgccgccgccaggacccccacttcgaacagcagccacagcggcaccgccagcatggtctgcgacagcacgtccggcggcgtgacgatggcggccaccacgaaggcgccgacgatcacgtaaggccgcgcctcgcgcagcttggccaccgtcaccacgcccatccgcgtcagcaggatcacgatcaccggcacctcgaaggtggtgccgaaggcgaggaacatgccgagcacgaaggacaggtatttgtcgatgtcggtcatcatgctcacccccgccggcgtcaccgccgacatgaagtggaacaccaccggaaacaccaggaaataagcgaagctcatccccaggaggaacagcagcaggctggccagcaccaagggcaggaccagctttttctcatggctgtaaagcccgggcgcgacaaaggcccacacctggtacagcgtgttgggcagcgacaccaggaaggccaccagcatggtcaccttcatcggcacgaagaaggtggacgtgacttcggtggcgatcatgctgccgccctgcggcagcgcgtccagcaaaggcttggccagcagatggtagatgtcggacgaccaatggaacaggccgaggaagaccagggcgatgcccaacagggcgcgcaccagccgggtgcgcagctcgatcaggtgcgcgagcagcggttgttcgttcattcgcgggcttgggaggcggagggttgggaagcgggcggatggtgcggcggcagatcgtcgaacaggtcgagctggttttcgtcgcgcggcgcggcggcttcggccgcggccggcgcctcggccgcttccgcttcgggatgcaggctctggtgtatcgtgcgctcggcctcgaacagcgggccggcggcctcgtcagccagcgcgcgcgcttcggcggcatggccatccaccgcctgccgcacttcattcacttccgcttccagctggccgcggaaggtatgggcggcatcctgcaagtcctggcgcaggctgtccagcccgctcaggttggcctgctggtggatgtcggccttcaccgtggcgacgaaacgctgcgcgcgcgccaccagcgcccccacggtgcgggccacggtgggcaggcgctccggccccagcaccaccagcgccaccacgccgatcaggacgaattcgccgaaactgatgtcaagcacgccgcgtcaccgtgcttatttcttgtcggcttcgccgtcgatgatgcggccggtctgctcgggaggctgctgcgcgccgcccttgccttcgttcatgccttccttgaaacccttgaccgcattgcccagatccttgccgatattgggcagcttcttggtgccgaacaccagtaccacgatcagcagcacgatcagccagtgccagatgctgagagaacccattttcactttccttatttcagaaacgggcggcgccgcgcgacgcccaggcgcgctcagcctttgtggccgaacacgtgcacatgcaggtggaacacttcctggccgccgccgcggccggtgttgatgccggtcttgaagccggactccaggccctgctccttggccagcttcggcgccagcgtcagaatccggcccagcaccgcctcatgctcgggaccgcaatgggccagcgaatcgacgtgcagcttgggaatgatcatgaaatgcaccggcgcgatcggacgaatgtcgtgaaaggccagcacgtcgtcgtcttcgtaaaccttgttggcgggaatctgtcccgccacgatcttgcagaaaaggcagtcgctcatcttgtatcccgtatcaggcggagggtttgcgcgaggctttctcgtccagcccggaaatgccttcgcggcgatgcagctccatcaccacgtcttccggacgcaggccatgatatgtcaacagcaccatggtatggaaccacagatcggcgacttcgcgcaccaggtgcagtttatccttgtccttggaggccatcagcgtttccgcggcctcttccgccaccttcttcaggatggcgtcctcgcccttgtggaacagcgaagccacgtaggacgattgcggagcggcctcgcgccgcgcctccagcgtatcggcgatgtttttcaacacatccggggtcatatcgatatcctttgcgccgaaatccggcgattatgcgggcccggcatggcgcgctgatgacagcgcggcccggccagccattctaacccgtccgcctgccgcggcgttgatcggcggcaactcagccgtgatagatgctgtgcggatccttcagcacggcgtcgacgatggtccagccgccattctcgaaacggcggtaaaaacagctttcccgtccggtatgacaggcgatgccgccgatttgttctatctgcatcacgatgacgtcgccgtcgcagtccaaccgcaactccttcaccgtctgccggtggccggactcctcgccttttttccatagtttctgccgcgagcggctgaaataatgcgcgatgccggtgtcggcggtcagctgcaggctttcgcggttcatccacgccaccatcagcacccggccgctggccgcgtcctgggcgatggcggtcaccaggcccttgtcgtcccacttcacttcatccagccagctcatagccgcacctcgatgccggcggcgcgcatcgcctctttggcctgggccaccgtgtattcgccgaagtggaagatgctggcggccagcaccgcgtcggcgtggccttccttcaccccgtccaccaggtgctgcagattgccgacgccgccggaggcgatcaccggaatgcccaccgcgtcggacaccgcgcgcgtcagcggcaggttgaagccggacttggtgccgtcgcggtccatgctggtgagcaggatttcgccggcgcccagctcttgcatcttgcgcgcccactcgacggcgtccagcccggtgcggttgcggccgccgtgggtgaacacttcccagcggtcgttctccggcgtcaccgccttggcgtccagcgccaccacgatgcattggttgccgaaatggtcggccgcctcctgcacgaattcgggatgggtgaccgcggcggtgttgatgctgaccttgtcggcgccagcgttgagcaggcggcggatatctgccagcgtgcgcacgccgccgcccaccgtcagcgggatgaagacctggtcggccaccgcctcgatcacgtgcaggatgatgtcgcgctggtctgagcttgcggtgatgtcgaggaaggtgagttcatcggcgccctgctcgttgtagcggcgggcgatttccaccgggtcgcccgcgtcgcgcaggccgacgaagttgacgcctttgaccacccggccggcggtcacgtcaagacagggaatgatgcgtttggcaagcatgtgagtatccgcaaaaccggcagcgcgccgacgccgggaacgctcccggcggcggacgcgccgcctgcagccgtttttattcggccagttcgtccgccagcgtctgcgcggcggcgaaatcaatgctgccctcgtagatcgcgcggccggtgatggcgccttcgatgccctcttcctccaccgcgcacagcgcgcggatgtcgtcgaggttggtcaggccgccggaggcgatcaccgggatggtcagcgcctgcgccagcttgacggtggcttcgatgttgacgccgttcatcatgccgtcgcggccgatgtcggtgtagatcaccgagttgacgccgtaatcctggaagcgcttggccagatcgatcacattgtgattggtgatcttggcccagccatcgatcgccaccatgccgtccttggcgtccaggccgacgatgacttggccggggaaggcgtcgcaggcgtcatgcaggaagcccggcgtcttgacggcggcggtgccgatgatcacataggacaggcccatgtcgaggtaggcctcgatggtgtccagatcgcggatgccgccccccagctgcaccggcatgtcctcgccgacctcgccgaggatgtcgcggatcaccgccaggtttttgggtttgccggcgaaggcgccgttgaggtccaccagatgcaaccggcgcgcgccctggtcgcgccagtgggcggcaaccttgaccggatcgtcggagaaaatggtggcatcgtccatcgcgccctgtctcaggcgcacgcattgaccgtctttcaggtctatcgcgggtatcagcagcatggtgctaagtcgaaacgtaagttaaacattgccgtcccaggccaggaagttcttcatcatctgaagtccggcccggtggctcttctcggtgtgaaactgtgtggcgaatatattgccacgcccgacgatacaggaaaaacgctcgggataatcactttccgccaggctcagcgacgcgtcgccgggcgcaaagtggtaactatgcacaaaatagaagcgctcgccatcggcgatgccggcgaacatcgggtgggcgcggcgctggtaaacctggttccagcccatgtgcggcaccttcaggcgctcgccgccggcgaccaggccgtcggcgaagcgcaccaccttgcccgcaaacaggcccaggccggcggtgtcgccttcctcgctatgatcgaacaatagctgcgcgccgacgcagattccaaaaaacggcttgctctgcgtggtttcacggaccgcgtcggccaggccgtggcggttcaattcgcgcatgcagtcgggcatcgcgccctggccggggaagactaccttatcggccttcaccaccgcttccgggtcgcgggtgaggaaaatatcggcgccggtttcgttgacggcctgcagggacttcagcaccgagtgcagattgcccatgccgtagtcgatgactgcgactttcatcttgctacctgctcatattcgggttggaaccactccgcggcgcggctcatatgctcagcgtgcccttggtggacggcgtgatgccggccatccgctcgtcgtgctcgcaggccatccgcagcgcgcggccgaatgccttgaagatggtttcggcctggtggtggctgttgtggccgcgcagattgtcgatgtgcagcgtgaccatgctgtggttgacgaagccgtggaaaaactcggagaacaggtcgacatcgaactggccgatgctggcgcgggtgtagtcgacgtggtagaccaggcccgggcggccggacaggtcgatcaccacccggctcagcgcctcgtccagcggcacgtaggcgtggccatagcggcggatgcccttcttgtcgccgatggcgcgggcgaaggcctggcccagcgtgatgccgatgtcttccaccgtgtggtgggcgtcgatgtgcaggtcgcccaccgccttgacgtcgaggtcgatcaggccgtggcgggcgatctggtccatcatgtggtcgaggaagggcacgccggtttcaaagcggccctggcctgtgccgtccagattcagcatgacggtgatctgggtttccagcgtgttgcgggtgacggttgcggttctcatggcttcaggcgaaaaaacgttggatggcggacagcagcgcggcgttctcatccggactgcccacggtcaggcgcaggcagtggtccagcaacgggtggctgccgtgcagctgcttgatcaggatgccggacgccttcaggtgctggaacagcgccggcgcgtccggcgcgcggacggtgaggaagttggcctcggacgcgaacaccgccaactgcggcaacgccgacagcgcatcgctcaggcgggcgcgttcggcgcgcaattcggcggcctggcggttgaacacgtccaggtgcttcagcgcgaacttcgcggcggcgagggtcagcacgttgacgttgtacggcggccgcaccttgttcagctgctcgatccaggccgggctggccgcggcgtagccgaggcggatgccggccaggcccagcttggacagggtgcgcatcaccaacaggttgtccagctcgcaggccagatccatgaagctgtcggaggcgaagctctggtaagcctcgtccaccaccaccagccccggcgcggcgcggcagatcgccagcacctcgtcgcgggcgtagcgcggaccggtcgggttgttgggataggacacgaacaccaccgccggctgttcgcgctcgatggcggccagcgtggccggcaggttcagcgtgaaatcgccgttcagcggcacgccgacatactgcaggccggaaaacagcgcgttcatcttgtacatcacgaacgacggctccagcgccagcaatttggcaccgggacgcgccaacgcctgggtgaccagcgtgatcagctcatccgagccgttgccgagcacgatgtcggcgccggccggaatagcgaaggcggcgcgcagatcgtccttcaggccgccgccgttggcgtccggatagcggttcagcgccacctgggccagttcggcggccagcgcgtgctgcaattcgatcggcagcggccacgggttttccatcgcgtccagcttgatcaagccggcggccggcgccacatggtaggcgccgatggcggcgatctcgtcgcggacgagttgcttggcggtcagtttggtcgtcatcgtgtgtctgcggcgcggcgcgccgtcatgagcccgcgggcgggcaaaaaaacatcgtaacgcgtcggcgcgcggcgggctaccgccgcgcggccaggaagccgcgcctgttgcggcgcgggcacggcgcttacttgtccagccgcagttcggcggcgcgggcgtgggcggtcaggccctcgccatgcgccagcaggctggcgatgcggccgagcttctgcgcgccggcctgcgacacgcggatcaggctgctgcgtttctggaaatcgtacacgcccagcgggctggcgaaccgcgcggtgcggctggtcggcagcacgtggttggggccggcgcagtagtcgcccaggctttccgaggtgaagcggcccatgaagatggcgccggcgtggcgcagctgcggcagcagcgcgtccggatcggccaccgacagctccaggtgctccggcgcgatgtagttgctgatctcgcaggcttcggccaggtcggccacctggatcagcgcgccgcggttgccgaggctggcctcgatgatggcgcggcgcggcatggccggcatgagcttctggatgctggcttccacccgcgcgatgtaatcggccgacgggcacagcaggatggcttgggcgatctcgtcgtgctcggcctggctgaacaggtccatcgccacccagtccggatcggtgtcgccatcgcagatcaccaggatttccgacgggccggccaccatatcgatgcccaccacgccgaacacgcggcgcttggcggcggcgacataggcgttgccggggccggtgatcttgtccacctgagggatggtttcggtaccataggccagggccgccaccgcctgggcgccgccacaggtaaagaccttgtcgacgccggcgatataggccgcggccagcaccagatcattgcgctcgccgcccggcgtcggcactaccatgatgatttcgcctacgccggccaccttggccggcagcgcgttcatcagcaccgagctgggataagccgccttgccgcccggcacgtagatgccgacgcggtccagcggcgtcacctgctggcccagcagggtgccgtcttcgtcttcataactccaggagtgagcaagctgcttttcatggtagcggcgcacgcgttcggcggcggcggtcagcgcgtcgcgcacgtcggccggcagccgcgcgaacgccgcctccagctgctcgcgcgacaatgtcaggtcggccatggaggccgcctgcatgcggtcgaaacggttggtgtactccaccagcgccgcgtcgccgcgatgatggacatcggcgcagatggccgccacggcggcgtccactgcggggtcctgcgcggtttcgaaggccagcagcgcttggaggcgcgcggcgaagtcgggctgggaggaggacagtttcaacatgatgattctctgatgcttggagtctgaacagttggcaacgccggccgcaggcatacggttgaccgctacccagccggcatgcggatgaatcaggccggcacagcgccggcgaaagcgtccagcaccggctggatcgcgtcgtatttcagcttgagcgcggcctggttcaccaccaggcgcgagctaatgtcgatgatgtgttcgaccgccgccagcttgttggcgcgcagcgtgccgccggtggacaccaggtcgacgatggcgtcggccaggccgaccagcggcgccagctccatcgagccgtacagcttgatgatgtcgacgtgcacgcccttcttggcgaagtgctcgcgggcgatctgcgggtatttggtggcgatcttcagccgcgcgccctggcgcacggcggcgtcgtaatcgaagccttcctgcaccgccaccatcatcttgcacttggcgatgttcaggtcaagcggctggtacaggccggcgccgccgtgctcgatcagcacgtcgcggccggcgatgccgaggtcggccgcgccgtactgcacataggtgggcacgtcggaggcgcgcacgatcaccagctgcacgtccggatgattggtgccgatgatcagcttgcgcgaggattcgggattctccgccggcacgatgccggcagccgccagcagcggcagcgtttcttcaaaaatgcggcccttggacagggcgatggtcagcttcatgatgttctactgcggtaaaagtatgtggatcgtgtggaatcagccgaccagcgcgcggcgttcgcgctccaggaagccgacatagcgctggatcagggtttccatctgcggcgtgaggttgagataggagcagcctatccgcatcgcctcgttgccgttgcgcatgcgcgcggtcaaccggtggcgcacctcgatgccgaggttgagcgtgccgaacggcttcaggtctatcgtgcattggcggtactgctggccgatttcgaaaccggtggtggacacgccgggcagccacagactcatgccgcccaggctgatgtcgaacagcgccaggtcgatggcgcgctggccgaagtcggcgatatggcagaacaccggggtgcccagcggggtctggatgcggaaaaactcgcgccgctgcagcttgatcacctgttcgggcagcttgctgaggaaggccggccggccctccagcatcaccttgctcacctggcccgtgacgaactgggttttcactccttccggcgagcagacgaagacattgcgctcgctgttcagcacctgggcattggtatcctcttccgcgccccagtcaaacgtgaacagacctgtctggaagtcgacatcgagcaggcgcgtcaggatgaagcttttccccttgttggcgaaaaccgtcaccatgtggccgtgcttggcgatgctcgccaggtgctgcgcgatctccgccggcgtggccagggtgaacttggccagatccagcggctgatgcgagcctgtcgggctgccgggagaggtgtcgttgctcacgatgttccgaccttcatgtctgcgaatgagagtgatacgcccagtttagcgtaacaactgctggatatcataagcaaggttggctgccggcgtgccataggcctgaaacaccctcagcttgcctttctggtccagcagataggaacccgcgctgtggtccacgctgtagccgccacccggcgtcggcactttctgcgccaccaccttgtattgcttcttcactttttcgatctgctccggcgtgccggtcaagccgatgaagcgcttgtcgaagtgcggcacgtagccggccagcaccttgggcgtgtcgcgctccgggtcgacgctgacgaacagcacctgcaccttgtcggcgtcggcgcccagctgcttcatcaccgacgcgtattccagcatggtggtcgggcacacatccggacaattggtgtagccgaagaacagcgccaccaccttgccatggaaagcctccaggccaagcggcttgccgtggaaatcggtcagcgtgaaattgccgcccatggaatcgtcatcgatcgccgtgcctttgaaattgacggcgggcgcacaggccgacagcgcgaacgccgtcagcaggccaagcaacaactgcaggaatttggacatcaggtaagcggtatcagacagtagtggtcgatcagtaaagccgcgaacagccaggtcagataccagatcgaccagcggaacgtgcggcgcgccagagcgtcagcatactggcgatgcaggctgacagcaagaaacagcagcctggcgtccagcagcaataccgctgccatgtaaatccggcccgactcacccaaagccactggcagcaaggtgatcgccgacagcagcagcgtgtacagcacgatggacaaggtggtgtagcgctggccgtgggtgaccggcagcatcggcagattggcgcgggcgtagtcgtcgcggcggtacagcgccagcgcccagaaatgcggcggcgtccaggcgtagatgatcaggaacagcaccagcgcgaaggcgctgatctcgccgctgaccgccgcccagcccagcactggcggcatggcgccgctggcgccgccgatcacgatgttctgcggcgtgttcggcttgagcagcagggtgtagacgatggcgtagccgacaaaggtggccagcgtcagccaggccgtcagcgcgttgcagccggcaaacagcagcagcaggcccatgccgcccagcgccagcgccgccagcagggtttccaggccgccgatctcgccggtgacggtggcgcgccaggcggtgcggcgcatgcgggcgtcgacgccgcgctccaccaggcagttgatcatcgccgccgccgccgccaccagcgcgatgcccagagtcgccgccgccagcaccgcggggtcgggcagccccgggctggcgagaaacatgccgatcaccgcgcagaacacgatcagcgccaccaccctgggcttggacagctgccacaaggcctgcgcgtgctgccgccacagcggcaaactcaattcgctcatctgccctctcccggtctggtgacgccggtcatgacggccggcgtcacccgcgccgccggcctgagttcagccgcgcgcggccgcagccgcgacagcagcaataaagcggccatcagcagcagcgccgcgccggcgttatgcgccaccgccagcggcaaaggcagctgcagcaacacgttggcgatgcccaggcccacctgcagcagccaagccgcggccagccaggccagatggcgccgcagcggcggcagccgccagcccagcgccagcaccgacagcaacagcagcgacaccagcagcgcgcccagccggtgcagccaatggatggtcaccagactggcgaaatccagcaggctgccgtccggcgcctcgcccagctcgcgcagcagatggaaggcatgatcgaaccgcagggccggccaggcgtcgccgttgcagccgggaaacccctggcaagccagcgccgcgtaattgctggacacccagccgcctagcgccagctgcagcgccagcgccgacgccagcaggccggacagacggcccagcagcggcggcgctgtcaccgcggccagccgcggcgatgctgccatccacgccaggatctgcagcacgcccatgccgcccagcagatgcgaggtgacgatggccggcttcaacaacagggtgaccgtcagcatgcccagcaggccctgcgtcagcaccacacccagcaacaacgcagccggcagccgctgccggccggtgcgccaggcctgccaggcgatcaatacgatcagcgcgcccaggctgccggccaggtagcggtgcagcatctccttccaggccttgtccaggctgaccggcccatccggcgccagcgcctgggcctgctggatggcaagcgccgcgtgcgacggcgacaactggccgtagcatccgggccagtcgggacagccgaggccggcatgggacaatctgacataggcgccgaacggcaccacgaccgcggccagcagcaaggccagccaaaccagttttcgcatggcaaaagtcccctatcgcgcaacgcgtccgccggccagccgccggctcagcccaagccgttgttcaccttcagcaccttcgccacttcatcgatgatccgccgcgggtcggcgccgtcctggtagaacatcacctgattgcccagcgggtccaccaggtaaaagccctggttgcccgccggcagcgcctgagcggaaatatgaggcagcctgtgcggaacatcgtccatcgccgccgcccgcggcgacaccagcagcgccacccgggtcagccgggatgccgcctctccttgcgcccgttcaatctgccgcatcgcataccagcgctgccggcagcggttatggcagtccgcgcccagcaccgaggccagcacccacttgccgcgcggccactccggctggccggacgcggcgaagggatgggtgggcaacaactggccgtagctgcgtccgcctcccggcggcagcagcgcataggccagccacgccgccaccaccggcgccaggcatagcagggccatcgcgatcagcgctctttgtccgcgcttaatggacttcatgtcggcgtctccacatcagccagctcaagccggtcaggcaaaatcccaacaacagccactggatggcgtaggcgtaatgtcgatccggcatgaactccggcaccaccggccagtgcagcagcgggtcgggagagttctccagcaccaccacgccctggaaccaatgcccgggataacggcggcgcagcgccgcctcgtccacctcgtccaccggtcccgccgtacccttggccgcgccggacaggacgaaatgatggggcgtcggcatccggtagccctgcggctgaatctgttccggcggaaagtcaggcattttggcgccgtccaccagccatcccaaatccagcaacaccagtgaacggtccggcccctgccgccagggctgcaggatgcggcggccgctctggccgcccagatagctgttgcgcagctcgatgaccggtccggccggctcgccctgcgccagccgcacccgggtgaaggccggcggcggctccgcctcccggtacaccaagccaaccggcgcggtgctcatcgcgctggtcagcgagcgcatcagcacttccttgtcttgaccccgctgccactgccatactgccaatgcataaggcaataaggtgatcagcaggagcagcagccatagcgtccgctgccaccctggccggcgctgcttcttttccgaatcggaatgtgtggaggatacggtcatgaaactcgtcatcctgttcttgcttgtctgcatcgtcctggcgttgttctgggggctgaccggactgctcaaagccgagcatggctcccaacgtctggtcagatcgctgaccctgcgggtcgggctctccatcggcctgttcctgttattgctgctgggcgcgctgttcggctggtggcgcccgcaccaggtttgactgccgccccccgttcatagccagtaaacgaagatgaacagcagcagccataccacatcgacgaagtgccagtaccagctggccgcctcgaaggcgaaatgctggctggcgtcgaaatgcccgttcaacgcgcgcaaccacaccaccagcaagatgatggaacccagcagcacgtgcaggccgtggaagccggtcagcatgaagaaggtcatgccgtaggcgccggaagccagcgtcagatgcagcgtggaaaacgcatggccgtactcgtgcagctgcagcgtcagaaaagagaagcccagcagcaccgtcagcagcaatcccagcttgaattgctcgcgcttgccttgcagcagcccccagtgcgcccaggtgacggtggcgccggagctgagcaggatcagcgtattgaacgccggcagcccccaggcctccatcgcctggtaagcctcggtgatgcccggcccggtggccagcggccacgacgcctggaagtccgggtacagcatcttgtagtccagcgagcccagcagcggcaccgacaccgtacgcacccagaacagcgcgccgaagaaggcgccgaagaacatcacctcggaaaagatgaaccagcccatcccccagcggaaggacatgtcctcgcgccctaggtaaacgccatggcggctttcgcggatcacatcgccgaaccagcccaccagcatgaacactaggatcaggaagcccagccccagcgacagcttgcccaacagcaggccgttgaccgcgaaagccgcgcccagcccgatgaagaacagcgccaccgcccccaccatgggccagcgcgatggcggcggcacgaaatatcggtcctgctcggcgacggacgccatttgctcagttgacatgtcttcctcctagctggtcacccaggacaccaccaacagcaacagcgcgatcagccccgccatcagcagcagggccgtcgcgatcaactgccacggcttcaagatctgatccaccctggccgcggaacccttgcgcacgccgatgaaagcgcccagcaccgcccgcactccttgcacccagctcatgacttgcctccctgccccggcacatcgaacacggtgtaagccagcgtgatgctggcgatcgaggccggcagcttgcggtcgatcacgaacaccaccggaaaggtgcgggtctgtcccggcaggaaacgctgctgggtgaagcagaagcactccagtttcttcacatactgcgcggcctcgccgggcaggtagcgcggcagcgcctggccgaccacctcgtgcgggctggcattggtgatctggtactgcacctggacgaaggtgccgggtttgaccttcagatgcctggtcagcggtctgacctgccatggcaagcccgcctgcaccgtggcgtcgaaggtcatgtcgacttcggcgccgccggccgccaggtcgccgctggacagctcgtccgccttcaccacatcgttcaggccggtctgctcgcagacgatccggtacagcggaatcatgccccaggcgaagccgaacatcagcgcggcgatcaccatcaaccgccccatcaggcggaagttgcggcgctgcgtcctggcggccgtgtccattgcgtcatcctcaatgcgcgcgcggctcgcctggcaggtgggacaggatcacgccgttctccccgacctcgagcttgggcgcctgctcgaagctgtggtagggcgccggggtcggcagctcccactccagcgtgttggcgccctcccacggcctttgcggcgcgaccgcgccgtgccgcagcgaatgcaggatgttgtacaggaagatcagctggcccaggccgaacatgaaggcgccgacgctggcgatctggttgaattcggtgaactgcagcgcgtagtcgggaatccgccgcggcatgcccgccagcccgaggaagtgcatcgggaagaaggtgacgttgaaccagatcatcgaccaccagaaatgcagcttgcccagcctctcgctgtacatccggccgctcatcttgggaaaccagtaatagatggcggagaacaggctgaacagcgcgccggccaccagcacatagtggaaatgcgccaccacgtagtagctggcgtgcagctggatgtccaccgccgccacgctgagggtgatgccggacagcccgccgatggtgaacagcaggatgaagccgatggagaacagcatcggcgtctcgaacgtcatgctgccttcccacatggtggcgatccagttgaacacctttaccccggtgggcaccgcgatcagcatcgtcgcgtacatgaagaacagctgggcggtggccggcatgccggtggcgaacatgtggtgcgcccacaccatgaacgacagcacgccgatggagctggtggcgtaaaccatcgaggtgtagccgaacaggggcttgcgcgcgaaggtcggaatcacctggctgacgatgccgaaggccggcagcgccatgatgtagacctcggggtggccgaagaaccagaacacatgctggtagagaatggggtcgccgccgccggcggcgttgaagaagtggctgccgaagtggcggtcggccagcaccatggtcaccaccccggccagcaccggcatcaccgcgatgatcagataggcggtgatcaggctggcccaggcgaacatcggcatcttcatcatcgtcatgcccggcgcccgcaggttgaggatggtgacgatgatgttgatcgagcccatgatggagctgatacccagaatgtggatggcgaagatggtcatgtccatccccacgcccatctgggtggacaggggcgcgtacagcgtccagccggccgccgccgcgccgcccggcaccgcgaacgacagcaacagcagcagcgccgccggcggcagcagccagaagctccagttgttcatccgcgcgaaagccatgtccggcgcgcctatcatcagcggcagcatccagttggccatgccggtgaaggccggcatgatggcgccgaacaccatgatcaggccgtgcagcgtggtcagctggttgaacagctccggctggaagaagcgcaggccggggctgaacaactcggcgcgtatgcacagcgccagcacgccgccggacaggaacatggtgaaggagaaccacaggtacatcgtgccgatgtccttgtggttggtggccatcagccagcgtgcgatgccgtgcggcttgccgtggtgggcgccgccggcgtgggtggtttctgcgattgccatgacgtctccttatgccgctttgccgcgcgcggccttcacttctttgggctgcaccgcctggccggtatggttgccccagctgttgcgctcgtaggtgatcaccgccgcgatgtcggtatcggacagctgcttgccccaggccgccatcgccgggttcttcttgccgccgaacagcacgatctcgatatgggcggccttgtcgccggtggcgatgggcgagccgtccagcgcggggaaagtgccgggaatgcccttgccgttggcctgatggcaaggaatgcagttctgggtgtagatcttctcgccgcgggccttcaggtcctccagcttccacaccttgttgggatcgtcggcgctggccgccatctgcttgatcttggcctcgcgccacttggcgtagtcgtccggcgacttggccaccaccacgatgggcatgaagccgtggtccttgccgcacagttccgaacactggccgcggtaggtgcccggctgttctatcagcatccagctgtcgcgcaggaagccgggcaccgcgtcctgcttgacgcccagctgcggcacccaccaggagtggatgacgtcgttggcggtcagcagcaggcggatcttgcggttggtcggcaccaccagcggctcgtccacctccagcaggtaattggccggccgcgggatcttgccctctatcgcctcgcgcggcgtggacaagtggctgacgaagccgaagttgtcatccagatagtcgtagcgccacttccactggtagccggtgaccttgatggtcatgtcctcgttgcgagtgcctttctgggccagcaccgcccgggtggcgggcagggcgatcagtaccaggatcagcagcggcaccacggtccagatgatttccaccgtggtgttttcgtggaactgcttggcctggtgcccggccgacttgcggtggcggatgatggagtacagcatcaccaggaacaccacggcgaagatgacgccggtgatgatcagcagcagggtgtgcagatggtattcggtgcgcgccagcggggtgaccggcgcctgcaggttgaattccgccgccgccgcgctttgcgcggccagcagcaaacagcacagaatgcgcaaacaagacatgtcgcccccctggtggtcaaatgaccgacacaatgaaatgcatgcacagccgccggttaggcccggcatgctttcatcgtaggagctaagtcaggaaaaacaagaagctgtcatgacgcggcgcaatgccgcgggacaagaggataagccgcggcctgaacgctgccgccgcagccgatcgggcccgttgcggcacagccattcgccgggcggcgcgcgccgccgcgtcggcatgccaggcctcgggccatccggcggcgcgtttggacgcggcccgccaacatgcgcctgctggccggagtgacaggccggatgcgagtcgcacagcggccgtcatcgcctagccatggggtcagcggcgcttgccgtcggccagcccatccgccagcgcgggcagttccttgagaaaggcctcgcgcgagcgcacgcctggggtgcccggcagtttgccatcgtcctggatcaggcgggcgaatatcagccggcgctctccctgctcggcccagccgacgaaccagccatacgggtgcgccagatcctgcttgccgttccgcagccaggggtaagccatgccggttttgccgcgcacgttccagccgccgggcagcgcggtttgttcgacgatgctgcgcgccaaccgttgcgcctctggcgaggccggcagccggtcgtgcagcagattgtcgaggaaagccacttgctccaacggcgacactttcagcgaagagccgatccaagcccgctccaggccattgttcttgccgggatcgccggagaaatcggcattgccgtagccgaatgcccgcacgtagcggcccagcgcctcggcgcccaggcggtgggtaatctgctgcgaataccacactaccgaatatttcagccagcgcgtcggatcggtgtcctgccgccacgcctcgccgccccagtcgacataaccctggcggtagggcagcgccggcgcatgctcgctcttgagaaagccggcatcgtatcccatcaccgccagcgggatcttgaatgtggacgccggcgagacgcgatcgcggcaatcgccctgctgcagcaggatggcgccgctgtggccatcggccaccgccgtgcaaatcgtcttggcctgggctggcgcgagggcgcagacggctgccagccagcctgccgccagcgcgatcgggtgcttcattgaatttccttgtccggatgatcagagtagatatctgtcagccagccggcgcggatgttcccgacgccgcggcgaatcatggctggtacgggatttccagcagcatcggcgccgggatatggcgcttgagggtttccagattctcgtcatacgcggcctgccgcggctgcggacaattggccacccagccggccagcgccaggccgctgccctggatggcgcgcgccgtcagcaacgcgtggttgatgcatcccagccgcatgcccaccaccaggatcaccggcagggccaaatcccgcgccaaatcctccatgaacagcgcatcggtcaatggcgccagccaaccgcccgcgccttcgaccagcacgatgtcggcctgcgccgccagttgctcataatgctggcggatgcgcgccaagtcgatctccactcccgcctggcgcgcggcgatgtgcggcgacaccggcggcaaaaagcggtagggattcatcagctccagatcggtttgcccagtggcggcggtcaaacgcgccacatcgtcgttatgccagcggccatccggcaaaatctcgcaaccggacgccaccggcttcatcgccagcaccgatctgccttgcccccggtaatggcggatcagctcgactgcggaatgggttttgccgatctcggtatcggtgccggtgatgaaatagccctggctcattgcggtatgtcctgtggtgaaaccgccggaaaacggcgaaacagcggcagttctacaccagcgcgcgccagtcttccagtatttccaccatcgattcgcccgcatccaccctgacattcacccccagcggcagggtgagcatcgggtgggtatggcagcagtcgaagtcggcgagtatgggcagcggcaggccatccagcacctccagcagaatgtaggacggtctgcggccagtgccgcaatcatcgaaaccctcatgcttgcccagcaaaaccgcgccggctttgtcgaatatcccggccagcttcagcatggcgaggttcttctccaccgtggccgcatctttcaggccatcctccaacaacaggatgtccccttggcggataggcggaaaatattcgctggcgagaaagccgtacagcgtattgagattgccgcctatcaggcggccctcagcgcggccaggttgaatgcagcgccactggttggcttgcagcgtcttgggccgatcctggctctcccacggcagacgttcatcgctccaatgcgcgggcatccgcaatgcgtatggataggacggctcccccatcgccaatgctgcaaaagcccgccaggtctcctccaccagcggcggaaactcgcccagcgacgcgaccagcgcagggccataaaaagtcgggactccggttttcgcatacagggccagcaggatcgcggtggcgtcggaatagccgaccacgatcttgggatcgcggcggaaggcgtcatagtccagataaggcagcatcgcattgctgttgctgccgccaatggtggacatgatgcaacgcacctcggggttgcgcagcaaggcattgaactccgccgcccgctcgcgggcgctgccggaacggtagccgtcgtcggcgccggtcaacgcgccgggcaggaaacgcaatccctgcctgccgacaaactccaccgcgcgccggtaacgcgccggctgcctcgccgtgatgggaaaagaaggactgaaacaggcgagcatatcgcccggctgcaaatgacgcatcgcgctgtctccggatagtggcataaatcctaggtctagccacaagcaataacccgaacgtcatgcaagaatcaagctccacaactaatctatgacagagaggagccggatatgaacgaaaacgaagccttcgcgacgctggccggcatgggcatcatgatgctggtggtcgcgggcgcgctggcgctggcggtcagcatcttctactacctgacgctgcaccagacgatgaacgcgatcagcgaggtcaaccggccgctggccggcggcctggtctggctggcgctgatccccttcgtcggcgtgatctggtacatggtctacatcatcctgctgtccaacgcgctgaaacgggaggcggcgcaacgcggcctgcccggcgacggcgccgccggcgtcagcctggctctggccatcctgctggcgctgtgcttcgtgccctacgccaacctgatcgcggtgattcccgccatcgcgctgtgggtgatccactgggcgaggatggccggctaccgcaagctgctgcaggcggcgcagccggcattggcgacctgatggcagcgccggcggcatggcaacgccgacctcgtgggtcggcgctgtgccgtctgccttgtgagccgtggcgcaataggttggccggataggcctgcggatttcacgcgggatggagtgaaagcctgttcggtctggcagggcgggccggcgggcgcaacgacaagaacgggatggaaaaccttgccgcctcccccggtccgcgctgccgcgccgggaaatcgaaaaatcagactatggcctgggcgtgcaccttcacttcgctggagagcttgttcagcgccgacagataggccttggcgctggcgacgatgatgtcggtgtcggcgccctggccgttgacgatgcggccgtcctgctgcaggcgcacggtgacctcgccttgcgactcggtgcccttggtgatggcgttgaccgaatacagctgcagctcggcgccgctgtgggcgatgctttctatcgccttgaacgcggcgtccaccgggccggagccgctggattcggcatggcgctcctggccgctctcggcgaacacgatgctggcctgcggcgcctcgccggtttcggtggcgatgcgcagcgacacgaacttgtaatgctcctgctcgatcgccaccatttcgtccgacaccagcgcgtgcaggtcttcgtcgaagatctcgcgcttcttgtcggccagctccttgaagcgggcgaaggcggcgttcagcgcctcttcgctgtccagcacgatgcccagctcggccagcttggtcttgaaggcgttgcggccggacaacttgcccagcgtcaggcggttggcgctccagcccaccgactcggccgacatgatttcataggtttcgcggtgcttgagcacgccgtcctggtggatgccggactcgtgggcgaaggcgttggcgccgacgatggccttattcggctgcaccgggtagccggtgacagtcgacaccagcttggatgccggcacgatctgggtggcatcgaccgcgctgtcgacgccgaacacgtcgcggcgggtcttcaccgccatcacgatttcttccaggctggcgttgccggcgcgctcgcccaggccgttgatggtgcactccacctggcgcgcgccgcccagcaccgcggccaggctgttggccaccgccatgcccagatcgttgtggcaatgcgccgaccacaccacccggtcgccgcccggcgtgcgggcgatcagctcgcggaagaaagcctcggtcaggcgcggcacagcgtagccgacggtgtccggcacattcagcgtggtggcgccggccttgatcacttcgccgaagatgcgggccaggaagtcgatgtcggagcgcagcgcgtcctcggcggagaactcgacgtcgtcggtgtattcgcgggcgatcttcaccgccttcaccgccgcgtccaccacctcgtccggactcatccgcagcttcttttccatgtggatggggctagtggcgatgaaagtatggatgcggccgcgcgcggccggcttgatggcttcgccggcggcgcgcacgtcgcgctcgttggcgcgggccaggctacagacggtggattccttgatcacctcggcgatcgcatggatggcgtcgaagtcgcccgggctggcggcggcgaagccggcctcgatgatgtccacgcccagccgctccagctggcgcgcgatgcggattttctcttccttggtcatcgatgcgcccggcgactgctcgccgtcgcgcaaggtggtgtcgaagatgtaaagacgatcgcccatattgatagctctccctgctccctgtgccggctcgccgaccagatagtcgttgaaatcaaagcgcctgccctggccggcggccagctgcgccagtcggctcagctgcgccagcggcaggctgccgcgttccctccatttgtatatcgccgcccggctcacctgctcgtctgggaacaaccggttcaattcatccgccagccgccccggcccgccgaagtccgccaccagtcgttctatatccacttgcatcgatgtgctcctgcagcatgttttacaccacactaaccagagaaggacatgtcgtcaaatttaatgccagatttctgtgtaaaattcgtcacacccaatgtccaaactacacaaattagacatttagtagaataaatcggcaattagctatcgaaaaccaccgcctccgttagcgcttccgcccgtggacagccgattcgactggcgccgcgcgccatgccgtctcgacaattgcgccgcaacatgaattcaattagcatttgattatcaaaaacattatgtttaacgactggtagcagccggcccgccggatgctgcgccgcccataccaactcatagagactgatcgatgcgaaagcttgcctgccttgtactgatgggaatgccgctgatggcctgcgcggaaggaaacgacggccagaccggcggcggtttttccggatcgctgggcttgggcgtcggctattaccgggtggaaaccaatttcttcaaaacccccagcgatgaccagcgttcgatttccagcctgaattcatccccggcgacgcagcattacgtcaccggcgtgccgtccgccaacctgcgctacgcgctgcccggcagcggcacccagctgttcctgagcgtggagccgctggctacgctgggcgagggcggcggcctgcaagccggcgtgcgccagacgctgccgggcgccggcaccctatctgccgcgctgaaatacgaccaggccagcgtctggcgcgacccctacgcgctgaataccgagcgcagcgacgacaagctgaaaacctacggcttcgcgttcggctggcacggcatcatggaaacgccgttcagcgccagcttcagctacggcaaggtcaagatgaaccaggagcaaagcgggcagaacctggggctgtcggcggcgaaccaggccctgctcgaccgcaacggcaagcaatacggcgcgcagctcgcttacacgctgaaactggatccggccggacagcaaagcctgagtccggcgttgatttatgtccgcaacgatctggacggcaaggcgatgagcaccacccgcagcggcctgcaactggcctatgcctacaagggcgacctcaatgagctgagcgccgcgctggccatcgcccgcaccggctaccaggccggcaatccgattttcgccggacgcaaggccgacagcgacgactacctgctgaccgccacctacacccgcaagcagctgttcggcgccaaggcctggtcggccttcgtcagcggcgtgtatggccagtccaattccgacatcagcttcttcgacgcccaggcccgcgcgctcaacgtcggcatcggctaccgcttctgacccgctaccggccgcagcccggcgccagtccggactgcggccgcgccccgcctcaaaccggcaatgcgcaacgccatgcgttataatccgccgtttacattaaatattttgagaacgcccgtgtccgagcgcctgtttgtattgtcccagcacgtgatgcccaagctggccctcacccgtttcgcgggatgcgtcgccggctggaagggcggcagcctgaccaccgcgctgatccgccgcttcatcgcccgttacaacgtggacatgagcgaagcgcaaaacagcgacccggcgtcctacgccagcttcaacgatttcttcacccgcgcgctcaagcccggcgtccgcccgctcgccgacgcgcgacaggtctgcccggtggacggcgcggtcagccagttgggggcgatagacaacggccgcatcttccaggccaagggccgcgactacagcgccaccgcgctcttggccggcgacgccgagctggccgcccgcttcgccgacggccacttcgccaccatctacctcagcccgcgcgactaccaccgcatccacatgccctgcgccggccggctgctggaaatgacttacgtgccgggcgagctgtactcggtgaacccggccaccgcccgcggcgtggataggctgttcgcgcgcaacgagcgcgtggtgtgcctgttcgaggacgagcaggggcagccgttcgtgatggtgctggtgggcgccaccatcgtcggcagcatggccaccgtctggcacggcgtggtcaatccgccgcgccggccggcgctggagaaatgggattaccgcagccaggacatccgcctggccaagggcgaggaaatgggccgcttcctgctcggctccaccgtggtgctgctgtacccggccggcccgctgcgcttcaacccgcaatggcagcccgccagcccggtgcggctgggcgagaaaatggccgactgagccaactccacaacggcgcgccagcgccgtttttttgcgcccggcagccctgccacgtccctgtcatccgcgaactgcggccctgcttacgtaaaaataactatcaagtaggaatacttgattgcctatccaaaaatgacaaggcacgcccggctcatgccgccgggtcggcaatcgatcaacgccggaggcagccatgcacatcaccgatgttttgcgcaaaaccatccacaaccccgccacctggagtcagcaggagctgtacgacaatctgcaggccgcggtggacgtggagctgtggaccatcccgctgtacctgaccaccctgtattcgatgcagggcttgaacgccgacgatcagcaggcctatccgggcgtggccaagctgatcgaaagcgtggtgatccaggaaatgctgcacctggagctgatttccaatctgtgcaacgcgctgggctacgcgccgcgatatccattccccagcaatgaagaaaccgagggcattcccttcctcaaacccgacgtgccgccgcaatacgccggctatcaagtcaagctggggccgctggacatcaaccagctcaagctgttctgtgtgatcgagttgcccgagccgcccggcaagccggactggaacaagcaaacccgctacaactcgataggcgagctgtaccaggcgctggaaatcgccgtcaaggtgcagtggaaagacctgtacgtcggcgcggccgccaacaccaagcaacaggccaacttcaccgactacgcgcagaaaaaccagcacggcgccggtttcagccagaccatcaacagcctggagcaggcgctggcggcgatgcaggccatcgtcaaacaaggcgaaggcaaccgcgccaccgcggaaatcccgctgcgcgaccagccgccggcggaaaatccggccaattacgaccccagcgatttcgatccggcgcagagccatttcctgaaattcaatgaaatcctcgacatcctgcgcctggggctcaccccctggattcccgccgtctacccgctgattccccgccccgacaagcaacaactggcggagcaggaaatggcccagcgccaattgcaggccggcttccgcgccttcatggcgcaactgcaaaccggcttcaacaccgcgcagcccaatcagcaaatgccgggcagcttctacaacagcatgttcaatctgcagaacctgatcaccgcggtctggcaaaccggcgcggtgccggcctttcccagcgagtgagccggccagccgccgccatgaaaaaagccgggcatcgcccggctttctgtttgccaacccgtaaaccgatgggtcagttcttggactggtccaccagcttgttattggcgatccacggcatcatcgcgcgcagctcggcgccgaccttctcgatcgggtgggcggcggtcagacggcggcgggcggtcatggacgggtagttggtcttgccttccaggatgaacatcttcgcgtattcgccgctctggatgcggtacagcgccttcttcatcgcttccttggtggcggaggtcaccacttccggaccggtcacgtactcgccatactccgcgttgttggagatcgagtagttcatgttggcgatgccgccttcgtacatcaggtcgacgatcagcttcagttcatgcaggcactcgaagtaggccatttccggcgcgtagccggcttccaccagcgtctcgaagccggccttcaccagctcgacggcgccgccgcagagcacggcctgctcgccgaacaggtcggtctcggtttcctcgcggaagttggtttcgatcacgccgcccttggtgccgccgttggccgcggcgtaggacagcgccacgtcgcgcgccttgccggatttatcctggtagacggcgatcaaggtcggcacgccgccgcccttcaggtattcggaacgcacggtgtggcccgggcctttcggcgccaccatgatcacgtcgacatcggccggcggcacgatctggttgtagtggatgttgaagccgtgggcgaaggccagcgccgcgcccttcttcaggttgggggcgatgtccttgtggtagacgtccggctgcgattcgtccggcagcaggatcatcaccacgtcggccttcttcaccgcctcggccacttccttgaccttgtggccggccgcttcggccttcttccacgacgcgccgtccttgcgcaggcctacgatgacgtcgacgcccgattccttcaggttctgcgcgtgggcatggccctgcgagccgtagccgatgatggccactttcttgcccttgatgatggagaggtcggcgtctttgtcgtaataaactttcatttctttgtccttggtattggtttgccaaggggcttgcagccccctgcttaaattttcagaacccgttcgcctcgaccgatgccggatgcgccggtacggaccgtttccaggatcactgtgcggtccaccgcctcgataaaggcgccgagcttgtcgctcgtaccagtcagctcgatggtgtaggtcttttccgtcacgtcgatgatgcggccgcggaagatgtcggccatccgcttcatctcctcgcggtccttgcctacggcgcggaccttgatcagcatcatctcgcgttcgatgtgttcggattcgttgaggtctatcaccttgaccacctcgatcagcttgttgagctgcttggtgatctgctcgatgacttcgtcggaaccgtgggtgacgatggtcatccgcgacagcgtcgggtcctcggtggtggacactgtcagcgaatcgatgttgtaggcgcgggccgaaaacagccccaccacgcgggacaaggcgcccgcttcgttttccagaagtatggataagatgtgtcgcatgccggccgccttagcacatattgccgtagtcacggttgttctcgaaaggcacctgctggatgtcgcgcatgtgcggcggcaggtccatctcatccagccccttgccgttctggatcatcgggaacacgttttccgactggtcggtgcggaaatccaggaacaccagacgctccttcagcttgtcgctgaacgcctcgcgcagcaccggctcgacgtcggccgggttctccaccttgaagccgacgtggccgtaggcctcggcgatcttgacgaagtccggcaacgcgtccatgtaggactcggagtagcgggtgccgtagaagaactcctgccactgccgcaccatgcccaggtagcggttgttcagcgccaccaccttcaccggggtgtggtactgcttggcggtggacagctcctggatgttcatctggatcgagccctcgccggtgatgcaggccacctgggcgttggggttggccagttgcgcgccgatcgccgccggcaggccgaagcccatggtgccgaggccgccggagttcagccattgcttggggcggtcgaacttgtagtactgcgccgcccacatctggtgctggccgacgtcggaggtgatgatggcctggccgccggtgatctcgtacagctgctgcaccaccatctgcggcttgatcagctcgctggacggcgtatacagcagacagtcgtggccgcgccattcctcaatctgcttccaccactggttcagcgccgagccatccggcttctggccggactgcttcagctgctccagcatttccttcagcaccagcttgacgtcgccgacgatgggtatgtcggcgcgcacgcgcttggagatcgacgacgggtcgacgtcgatgtggatgatcttcttgggacggccgaggaaatgcgacggcacgctgatcacgcggtcgtcgaaacgcgcgccgatggctaccagcacgtcgcaatgctgcatcgccatattggcttcgtaggtgccatgcatgcccagcatgccgaggaactggcggtccgagcccggataggcgcccaggcccatcagcgtgttggtgcacggcaggttcaaggagcgcaccagctcggtcacctcggcctcggcgcggccctgcaccgcgccgccgccgacataaatgaagggacgcttggcctcaagcagcaggttgactgccttcttgatttgtccgctgtgcccgcgggtggccggcacgtaggagcggatgtgcacgctttccgggtaatggaattccgcgcgctgctgggtgatgtccttcgggatgtccaccaccaccgggccaggccggccgctcttggcgatgtagaacgccttcttgatggtggcggcgatctcgttcacgtccttgatcaggaagttgtgcttcacacagggacgagtgatgcccaccatgtccacttcctggaacgcgtccaggccgatggccggcgacggcacctggccggagatcaccaccatcgggatggagtccatatacgcggtggcgatgccggtgacggcattggtcgcgccgggaccggaggtcaccagcgccacgcccaccttgtcgctggagcgcgagtaggcgtcggcggcatgcaccgcggcctgctcgtgcctgaccagcacgtgtttgaacttgtcttgccggaagatggcatcgtagatttccagtaccgcgccgcccggatagccgaatacgaattcggccccctcttcctgcaggcagcggactactatttcggcgcccgatatctgcatatcgcctctatttcatgttgatttcatcccgtttgctcaaagaccttagcgtattgctcaaaccatggtcaagcgattttgtgcaggtgcaaaaaagcgctaaatcacggttatttcaggagaaaaactcgtactagcctagcgattcctgctctgttaccatcgcaggttggcatcaacctgaaacgcacagatggcaagccgcaaggaaatggccgactttctgcagtcggtggaaaaacgcgccttcaagcaggcgctgtacgcggtgcgccaggaagacaatgcgctggacatcgtgcaggactcgatgatgaagctggccgaccgctacgcgcacgcgcctgccgacgaactgccgctgatcttccagcgcatcctgcagaacaccatccgcgaccactaccgacgcagcaaggtgcgcagcttcgtcagcaccctattgtcctcgctgatccccacccatgccgaggacgacagcccggatccgctggaaaccctggacgtggccgccgacgaggcgcacaccaatcctgagcagtggtaccagcgcaaggaagtggcgcagatgatagacgcctccctgcagctcctgcccgcccgtcaacgcgaggccttcctgctgcgttactgggaaggactggatgttgccgaaaccgcccaggtgatggggtgctcggagggcagcgtgaagacgcattgctcgcgcgccaaccacaccctggccgccattcttgcgcaaaagggagtactgctatgaatcacgccaacgatagccaaggcgaccatttgccgtcccacatcacccgcattctggacacccccaccgccgaacccacccacgcccagatggagcgcctgaaagtcgcccgcgcccgcgcgctgcagcgcttcgaccagcgcgccgccgaacacatcagcctgcaggaaagactggcgatctgggcacagcgccatacgctgctgctcaagcgcggcggcgccgcgctgggcttcgccgtggtcaccggggccggcctgatgctgctggacggcctgctggtggagagcgaagcggtcgacgccgcggtgctgtcgcaggacctgccgctcaactccctgctggagcccaatttcagccgggggctgcatgagtaagaccagacgcctggcctgctcgctgggcctggccagcctcttcgccgccgccttggcgcaagcttctcccctggcggatccccgctgggatcaattgaacagcgaacagcagcaggtgctgtcgccgctggcggcggaatggaaccgttacgcgcccaacaagaagcagaacctgctcgccatcgtcccccgcttcatcgacctgccgcccaagcagcagcaaagagtgcggcagcggctcaaggcctggtcggagctcagccagccgcaacgcgacgagatccgcgccaactggaaaaaattgcagcagctgccgcccgagcagcgcgagcgcgtgatgcggcgcctgcgcgagggcggcgccaaaccggaaaccccgcaataagatgaacgactttcccgtccccagcctgctccgctgcctggccagcctgtgctacgaaacgctggtgctggtcgccatcatgctgctggtcggcgccgcgctcacgccgctgcagttggtgctgggccaggattcggcgctgctgcacgcgctgatccagctgggcgtggccgccgcgctgttcgcctatttcggctactgctggacccgcagcggccagaccgtggcgatgaaaacctggcatatccgcctggtggcggccgatggccggctgcttggctggcagcaggcgctgatgcgcttcgccatcgccgccatgctgttcgtcggcctgccggtggtgtcctacctgggctggcaacgcagctacggcgaccatcccgccgtcaaatggctggcgctgatctggtggctgctgcctttcctcgcgcgctactacgacaaggacaagcgccatctgcacgaccgcctggccggcacccgcctgctggtgctgcccaagccgccgcgccgctagtcatccccgcaattgcggcgcgtcggccgcgaagtccagcagcgcgtccagcaccgcccgcacccgcgccggcagcgcgcgccgctgcggccacaccgcgtaaaccggccgggcggcgatctcccactgctccagcacgcgcaccagccgcccttccgccaattgccggtggcagatgctgagcgggctgaccgcgatgccggcccccgcctccgccaggcggcgcgtcagcagcatgtcgttggcctgcaaatcgggctccgccggccaggcggcctcctcgccggtttccgcatgccgcagccgccaacgctcaaacggctcggccagcagcaagcggtgcgccgccagatcggccggccgctccaacttgccgtgcgcagcctgatagtccggcgccgccaccagcatggtgcgcaccatgccgaccttgcgctgccgcagcgcggcgtccgattgctcccccacccgcagggccagatcggccatgccgctgtataaatcatccaggctgttgttcagcttcaattccagcttgagccgcggatgctcgcgcagcaggcgcgtccacaccggcagcagcatgtcgttggccatgctcagcggcgccagcagcctcaccacgccctccacccggttcagcattccatccagcgcggccgtttcccgccgcagcgccgccaatagcggcttgcagcgctcgtagtattgccagccctcgttggtcggcgccagccggcgcgcgctgcggttcagcagcttgcagtccaggcccgcctccaaggcctgcaggcggcgggtcagggtcggcgccggcatccccagccgcttggccgccgcgttcaggctgccggcatccacgatcgccacgaatagttccagatcatccagcatgattgcaaaaacggaatttgagattgattttttgattctattttcataatccatgtttggctagactgcgttcatccaatcgaaaccagccaaaccatgaacccgacgccgcgcccacgcctgcccctttcgacgcggatgccgctgggcctggccgctgccggggcgcttcgatccatccgccgacggcgcttcggcccatcacgcaacaggagcaagaccatgagagtcgattacacccaactgtcgcccaaggcttaccaaggcctgctggcctgcaagaacgcgctggcggaaagcccgctgggcctgcccttgatcgaattggcgtatttgcggatcgcccagctcaacggctgcgtgttctgcctgaaactgcacagccatgcgctgcgccgcaggggagaaagccaggagaagctcgacgcgctggccggatgggatgtggcggaagaaaagctgttcacgccgcgcgaaagagccgccatcacctggaccgaggcagtcacccgcataggcgaaagccgcgcgccggacagcgtctacctgccgctgcgcgaacacttcagcgacgcggagatttccgacctgacgctggccatcgcgctgatgaacgccttcacccgcgtcgcggtggcggtgcggcagtaagcttcagcctgaatgggccgggtgccacaccagcacccggttcgccgccggcagccatgcccgcagcgtcagcaaggcctgttgccgggccgcgtcttcggcagccgccggagacaacgccagcaagtccagcgccttgcggcaatcgcccagatcatgccattgccagcggccgccctgccacggcgcgaacaggttcagccagtaagtggccgggtcgatgtcctgcagcacattgccgctgaagggcagattgatctgcggcgcgaaaatccagaaccagggaaaaggcatgcggcctccatgcggaaggcggcaggcccggatggccgcgccgcctccgcttggtataaggccgcgcgcggccaggcgaaatacgtgcaaacacgatgcgcggcgcttatccacagctttggccatggcgcggacttatccacaaaaaggcgcagccgcctcgcctggccccgcgccccagcccgatttacgccgcgcggcggtacacctcgcggccggcgacataggtggccgccaccgcgcggtcgtcgcccagcatcatctgcacgaacagagcctccgacaagtcgcgcgcgtagcgcatgcggaaatccagcagcggggtggagcgcaggttcagcaccgccaggtcggcctccatgccgaccgccacgctgcccaccttgtcggcgatgcccagcgcctcggcgccgccgcgggtggccagatagaaagcctgcgcggccgacagtggcttgccgtggctttgcgccgccatataagcggcgttcatcgtctgcagcatcgagaagctggtgccggcgcccaggtcggtgcccagccccaccgccaccggccggtcgcccagcacgcagcggcgcaggtccaggctgccggagccgaggaagaaattggaggtcgggcaatgcgccagcgaggcgccgctggcgtggaacatctccagctcggcgtcggacaaatgaatgccatggccatagaccgcgcgcggccgcagcaagccgtagcgctgatagacgctggcgtaatcgcggcagccggggaacagcgctttgacccaggcgatctcgtcgaggttttccgagatgtgcgactggatcggcacgtcgggaaactccgccgccagcgcgcccagcatttccaattggccatggctggacgtcggcgcgaagcgcggggtgatcacgtattcggcgcggccccggccgtgccagcgctggatcagcgcgcgcgaatcctcatacgcggtcagcggcgtgtccagcagggcgtccggcgcgtggcggtccatgcacaccttgccggccaggatgcgcaggtctatccgcgccgcttcctgcaacaggatctccaccgaggcggagtgcacggtgccgaacacgcagccggtggtgacgccgttgcgcagctgctcggacaagaacacctgcgccacttcgcgcgcgtgcacttcatcggcgaagccctgctcggtgacgaaggtgtagtgatgcagccagtccagcagctgctcgccgaaggccgccatcatctcggtctgcggataatggacgtggcagtcgatgaagcccggcaggatcaggtgctcggggtaatgcgtcagccggacatccggcgtcagcgtcggcaacagcttggccgccgggccgcatgccgcgatgcggccgttttccatcaccaccagcgcgtcgcgctggaatgccaggctgtcctgctcggcctcccggaacgggttgccccggaaagtcagcacatcgccgcgtaccgctgttttcaagcttcgctcccgccgcgtcaggcggccttgtcgcgccggtgcggaagccgcggcgcatttatcttcacataaagaatcttcatgtataaatatagccgcgtttcacgcctctggcaaatccgccgccgcggcgcaagcgccaaagcgctgatcttcaacaacttgtctttagatgaagatagtatattttcaagtcgtgatactcttgcgcccgaacccgtttgccgcgtttacctttggatcaggaaccagcagcatgcagcaagtaccagaccagattgaccgtatcgtcgccctgtggaacgaggtccgccccgacctggacacctcgtccacccaagtcatcggccgcatcgtgcggatggaatacttcatcacccgccgggtgctgcaggacttgtcccggcacaatttaaatgtaggcgaattcgacgtgctggcggcgctgcgccgcggcggcgagccctaccagctgtcgcccaaccagctgcaaggcatggtgctgatttcatccggcgcgctgaccaaccgcatcaaccggctggaagaagccgcgctggtcagccgctcgcccgatccggacgaccgccgcggcgtgatcgtcaccctcaccgccaaaggcctgcaggtgatagaagacgccgccggccaccacctggcggcggaggcggagctgatggaaatgctggacgccgacgagcgcgacacgctggcgcggctgctgaagaagatgctgcaggcgcaggaagactgattccgcgaacaggccgcccccgggcggccttgatttcgcccttcgcccggcaaggcgacgccacgccgctcaccccaagagcagcgcgcagttggcggccaatatcagccagaacagaccccagccgcagacgactacccaacgcagggcggcgtgcgcgcccatcagcgcccggtccccggtcatccgcagcagcggccacatcgccagcggcagctgcaggctcagcaccacctggctccacaccagcagcgggccgacggcactctccccccaccagccgatgcctcccgccgccggcagcaaggccagcgcgcgggtgatcagccgccgctggtagcacggaatgcggatcttgaggaagccgtccatgatcacctggccggcgacggtgccggtcaaggtggcgctttggccggcggccagcaaggcgacgccgaacagcaacgccgccagcgagccggccagcgggcggatcagttcgtgggcgtcggcgatgtcggccaccgcggtatggccggcggcatgaaaggcgctgcccgcaagcaccaggatggcgccgttgaccagcatcgccagcagcagcgaggcgatggtgtcgatccggcacagcagcagcgtctgccgcaacgcgccgtctcccccctccacccgccgggtctgcaccaccgacgaatgcaggtacagattgtgcggcatgatggtggcgccgacgatgcccagcgccagcaccacggccttgtccatgtcgtgcgccggcaagctgggcgccaggccggccgccaccgccggccaatgggtatccagcagcgccagttgcgccagaaagcacagggtgatggtggcgatcagccccagcacgatggcctccagctggcgaaagccccgtcccttcagccccagcacgatcagcgtgtcgaacgcggtcagcgccacgccccacagcagcggcacgccgaacagcagtttgaacgccagcgcgcagcccagcacttcggcgacgtcgcaggcgacgatggagacttcggcgctcagccagtgaagcaggcggccggcgcggccgtagcgcgcggcgctggcctgcgccaggtccatgccggtcaccagccccagcccggccgccagcatctgcaacagcatcgcggcgatgccggacagcatcaccacccacagcagctggtagccgaagcgcgagccggcctcgatgtcggtcgcccagttgcccgggtccatatagccgaccgccaccagcaggccggggccggcgaagcggcgcaggcgctggctgaacgaggcgcgcgcgtctatgcgtatgctgccgttgacctcggccgggcagaacggcgcggtggcggtggtggggagggagaacatgggggccgcggggagagttcagttccccgccagcataacgcggatcagcgggcgcgcggcagattgtcgccgaccgcctgcaacgccggcggcgcgctccaggaccactggcgcttccaggcgcccatcacctgccccggatattccggcttgcccaggctgccgttgtagcggccaagcgcgcggtaaagattgccgtgctcgatgtcgagatagtggcgcaggatggtgcagccgtaacgcaggttggtggtcaggtcgaacagattgtggcgcggatcgccgatgtggcgcacccagaacggcatcacctgcatcaggccgcgcgcgccggggctggagagcgcgtatttgttgaagccgctctccacctggatcagtcccagcaccatctgcggatccaggccggcgcgggtcgcctcgtactggaccgcggtgagcaggcgctcgcgcatccaggcgtcgggaatgcgcttttgcagccgcgccgacatctcggcgagccaggcctggccgacgcggggatcgtcgaacaccagcctgggcgcgttgacgtcggaaatcgaacggctcatcgccgaggcgacattggccgacagggcctcctccttctgcgcgccggcccgcgccggcgcgtgcagaagcgccaggcagcagaacagcgggaggaggaggctcgtcttcatcaggccagcttggagaggacatgctccagaatagcatcggcggcgacggcggtggcttcgctgtcgcggcggtgctggtactcgaccttgcctgccgataggccgcggtcgccgatggtgacgcggtgcggcgcgccgatcagctcccagtcggcgaacatcgcgcccgggcgctcgccgcggtcgtccaggatcgcgtcgacgccgcgggccagcaggtcggccagcagcttgtcggcagcttccttcactgcttcggagcggtcatagccgaccgggcagatcaccaccgcgaacggggcgatggcatccggccagatcatgcccttgtcgtcgtagttctgctcgatggcggcgcccaggatgcgggtgacgccgatgccgtagcaacccatctcgaacggtttcggcttgccgtcttcgtccaggaaggtggcgttcatcgccaccgagtacttggtgcccaggtagaacacgtggccgacttcgatgccgcgctggatcgccagcacgccctggccgtccggcgacgggtcgccttccaccacgttgcggatgtcgaacacttccggctcggcgcagtcgcggccgaagttggcgccggtgtagtgctggtcgtcctcgttggcgccgatgacgaaatcggccatcttggcgacggtgcggtcggcgatcactcggcccttgaagcccaccgggcccagcgagccggggttggcgccgaaggcgtcgcggatggcggccgggctggcgaacgccagcgggttcttgatgccggcgatcttctgcgccttcacctcgttcagttcgtggtcgccgcgcaccagcatcagcacggcctcgtcctcttcgccttccaccaccaccgccttgacggtctgttcgatgtcgatcttgaggaaatcgaccaactcggcgatggtcttgaccttgggcgtatgcaccttggccagcgcggccgcggccgcggcgcgctcgccggccggggccaccgcctcggccagctcgatgttggccgcgtattcggaagcggggcagtagacgatggcgtcttcgccggtatcggcgatcacctgaaactcatgcgagcggtcgccgccgatggcgccggtatcggccgccaccgcgcggtaggtcaggccgaagcggtcaaagatgcggcggtaggcggcgtacatattgtcgtagctcttgccggcgtcttcggcgctgcggtcgaacgagtacgcgtccttcatggtgaattcgcggccgcgcatcacgccgaaacgcggacggcgctcgtcgcggaacttggtctggatctggtagaagttcttcggcagcgcgcggtaactgcgcagctcgcggcgggcgatgtcggtgatcacttcctcggcggtcggctgcagcgcgaaatcgcgctcgtggcggtcctggaagcgcagcagctcggcgcccatcgcatcccagcggccggtctcctgccacagctcggccggctgcaccaccggcaggctcacttcgatgccgccggcgcggttcatttcctcgcggatgatggcttccaccttgcgcaccacgcgcaggcccatcggcatccacgagtagatgccggctgcctgcttgcggatgaagccggcgcgcatcatcagcttctggctggtgatgtcggcgtcggcgggggcttctttcagcgtggagatgaaaaactgcgatgcgcgcatggtgcgtccttggaattcggctaaatggcttcgattgtagcgttgacaggggctggcggccaagcctcggcggcggcgcgcgccggctcgcaccgcttttggccagttgttgcagtacaacaatcgtgcgcgcaccgcggacgcctgcgcttggctcgccccggcgtctggagtaacctgcgcgcagccggaccgtttatggcttttttattccgcctccatcatcaacaatgaggggatggcggcagccatcgacgcccctccgggtccccacgccgctgcggcagcgccagcagcgacgcataaccgttatggaagcttatgcaggatcacaataaacaggcgatggctggcctgaccctggccgcgctcggcgtcgtctacggcgacatcggcaccagcccgctctataccttgcgcgagtgtttcgtcagccagagcatccccaccaccccggacaacatcttcggcatcctgtcgctgatcttctggtcgctgatcttcgtcgtgtcgatcaagtacgtggccttcgtgctgcgcgccgacaatcgcggcgaaggcggcatcatggcgctgatggcgctggcccgccattacaccacccatgccgcgcgctggaagatcgtcatgctggggctgttcggcgcggcgctgttctacggcgacgccatcatcaccccggcggtgtcggtgctgtccgccgccgagggcatggaagtcatctcctccggcatggaggcctacgtgctgccggtggcggtcggcgtgctggtggggctgttcctgctgcaaaagcacggcaccgccagcgtcggcctgctgttcggtccggtgatgatggtgtggttcgccatcctcggcatcctcggcctcaaccagatcctgcagcagccggcggtgctgcaggcgctgaacccctggcacgcgttcgccttcctgcaccagcacggcttccacgccttcctgacgctgggctcggtggtgctggcgctgaccggcgccgaggcgctgtacgccgacatgggccacttcggcaaaacgccgatccgccgcgcctggttcgcgctggtgctgcccggcctcgcgctcaactacttcggccagggcgcgctgttgatgcgcgatccggccgccatcaagaacccgttcttcctgctggcgccggactgggcgctgctgccgatgatcgtgctggccacgctggccacggtgatcgcgtcgcaggcggtgatttccggcgcatactcgctgacgcgccaagccatcctgctgggctactgcccgcggctggaggtgaaccacacctcggagaaggaaatcggccagatctacatgcccttcatcaactgggcgctgctgatcgcggtgctggtggtggtgctgaccttcaagagctcgtccagcctggccgccgcctacggcatcgccgtcaccggcaccatgctgatcaccaccatgctgttcttcgtggtggcgcgggtcaactggcgctggccgctgccgctggcgctgggcatcacgctgctgttcggcgtgatcgacaccgccttcttcgccgccaacatccacaaagtggccgacggcggctggctgccgctggtgatgggcatggccatcttcacgctgatgagcacctggaagctgggccgcgagctgctgttcaagcgcctgcgcgaacaggcgctgccgctggacggtttcatccagaacctggaagcctacccgccggcgcgggtggaaggcaccgcggtgttcctgaccagcacgctgcacggcgtgccccacgcgctgctgcacaacctgaagcacaacaaggtgctgcatgagcgggtagtgctgatgacggtgcgcaccgaggacgtgccctatgtggccgaagacgagcggctggaagtggtgcagatgtcggcgtcgttctggcgggtggtggcgcgctacggcttcaaggaagatccgaacgtgctgcaggtgatggaaatgtgcgcgaaggaaggcttcgagctggagctgatggacacctcgttcttcctgtcgcgcgaaaccatcgtccccaccgagcggccgggcatggcccgctggcgcgaaaagttgttcgtctggatgagcaagaacgcgatgcgcgccaccgacttcttccaggtgcccaccaaccgggtggtggagttgggcgcccaggtcgaactgtaagcccggcggccatcgccaggctgtttgccgcgacgcgccgcttccggcgcgtcgcccgcttgcccgctgctagcgcctggccacccggcgcagcgggctctcccgccgcgcgccccagcacagatattgctcgtacgccgtgcagaaggcggccagcacctgcgcgatggtcatcggccagatcctctccggcaacggctgcacccccatcaatatcggccattccacattgtccggcggcatcaggtcgcggcgttcggtcgccagcagcctggcgtcggccatcgccagcatcgcccggtcctctcccgacaggctgaggccgaaacgggcttccaccgccgcgcccacccggccctgcagcggcgagcgttcgtaggtgtccgccctcaccacctcgccggcgtaggccttggccgcgccgtacagcaagccggccagttgcagccgcggcggcaggatctccgccatccggatcgcatgctcggcctcgctgtagaactggcggcaagcgcctccgaagcggcacagatgcgccagatgatgggcgatgtcggcgatgtcgatatcgtcgggccgcgggtccagcacattgagatagcggccggacaccgtctgaataaatgcatttctcatcaaccgctccattgactcggcccgccggcaggcaggcctgcttcacgcccattcccgcgcccggccgcgccgccgatgcccgcatgagcgccattccgcctcggccggccacgcggcgcggcgacgaaatttattttgatttaataattgaaataattaattccaatagaatagaatcggttcgccccaaataaccgaatcgccagcgccattcatgcaaccacgctggcgataaagcctccattggaatgaactccggtgttccgccgacgtaaaacattcaggaagaatggcgacggatgccgaatatgttctaagaaagactaataaaacagaaacttgctatgacaccagtcataaacccgaaatttagcacagcgccgaactgattttccagtgccattccgggcaggatattcgcgacgcttcaattaacgtgaatttctaaattcgtaatatcgaaattaaaacctattcttgatgaggattcgtgtcatgcacgcaaaagacctccctaaaaacaatacttcgctgaatgaattcaagctgaaggccatcaagaaaattcacgatcaaaaactcaccatcagcgcgctggcccgaatgaccggcatcaagcagtccactttgcacaagggcttgttcgaagaaagggaattgtcgttcagcaatgcccacgccatcggcaacgcgctggacatcagcctgtccggccatggcgccgcgccgggccggatggcgccggtattgacccatttgagccagctgccgtccttgcgcggcccgggcctgccgatatgggatgaatacgtgctgctgcagcatgcgccgggcgaagccgttctggcgatagaccgctcgctgttccgccccgcgctgtttccggcccgcgccgtcgtgctggtgcaaaccggagagcgcgacggggcaaacctggtgtacccgcaccacgacgcgctttgccttggcgacaacggcaagccgccgctgggcagaatcatcggcatcaccttcaggaaaaaccaatgagaaccatcagagaactggccggcaaatcgctggccgcggtcgaccccatcgtcatcctgtcctttttgatcctgatttccgcgattgtgtccaatctgacctcatacaaggtcatccagattttcggcacggaagccagcctgggcaccttcaccatgcccatcatcctgatgctgctcaaccccatcgccgaggtctacggcaagaaccgctccaaccagatcctgttcgccacctgcctcgccgagatcgtcttcgcggtctcctttaccgcgctcagccagtcgcagcgcgactgcggactgctgccgctggccgaacgcgaccactgcgcggcgctgaaccaaagttatgtgctgatcagcgaacatatcgtcaggggctcgatctcgttcgcgctgggctgcctgataggcagccagttcaacacccgtttcctgctttacctgaaacggctgtggtccagccgcttctacttcgtccgcgacgtcttctcctcggtgataggcgaggtggtctacaccgccatctgcttcatgatcgccttttacggcgtgttccccttcgccaccatcgtcaagatcttcgccttcagcctgatgttcaaattctcgtccaccgtgctgctgtcctggatttctcaatacatcgtccagttgctgtaccgctaccaggcctggctggagccggcgccgtccagcaagaaaatcaaattctcctcgcgctacctgcaagtatgaaacccatcgtccttcatcaccggccccgcgccggccaaaccgccgccgcgccattgttcgcgctggaaagcaattacgactacacccgcaaataccgccgccaatcgcggcgggtggagcgggcgtcgctgacgctgctgtttttcgccgaccgcgtcatgctgctgccgcgcagcgccaacggcctggccatgctgcgggcgctggcggagcggttgccgctgcggcgcgacggcgacggcgacgccttcagcctggcgctggacgccagcgcgccgttgcggcggcggctggcgcagctgctggggctgctgcagccgttccaggccgatgcctgcttcggcctatacggtttcttcacctacgagctgctccatgccgaactgggcctgccctgcgatttgctcggcctgttccacctgccggagcagttaagcgtagacggccagccgcatggatactttgtcgaccccgaggccgacgacggcccggcgccgccgcccgacctggcgcgcttcatcgatctggaccgcttcgccgccggccgcaacgccgagcatgggccgatgtaccgcgccgccagccagcaaatcgccgacggccaagtacgctcggtcaaccccagcttcgccatccgccgccccaccgcccgcaacgcctaccagatttaccaggcgctgcaggcgaaaaacctggcgccgtacaatctgtttttcgacgccggccccttccagctggccggcgcgtcgccggcgatgttcctgcgcatccgcggtggccgggtggagaccagcccgatctgcggcaccgtcgcccggggccgcgacgaaacggaagaccgcgcgcagatcgccaaactgctggcttcggagaaagacgatttcgaactggcggaatgcgtgcgcgccgacctggcggccaaacaggccagctgccgcgacgcgacgctgctggcggccaaggaaatagagaaattcgccaacgtgttccacacttcggcgcacgtggcggccacgctgcgggaaggatgcacggcggccgacgccatagccgatcacctgtggccggccaccatcctgggcacgccgaccgccgccgccgcgcggctgctggccgagcatgaaagccgccactggtacggcggcgccttcggctatctgaccgccgccggcgaagtcgacctgggcaccatcatccgcagcgcgctgctccgcgacggcgtcgccaccacccgagtcggcagcaccctgacccgccactccagcgcgccggccgaacaaagggaactggaagccaaggcggcgctgatcctgggcgtgctatgaaagcgctgacgatagaggacatcagcggcgaggccatcaccatccggctggtgaacaccgccaaaacctaccgggtcggactggaccggccggtgcggctgcaggatatccgcgggctggccaaggacgagattctgctggccggcgtggtggccggcaaagtggcgcgcggcaatgccgcgctgctggcgcagtacgacttcagccaggtcgccatagccggcgacttccggctgcaaagcgtcattttcgaccagaatgtggccttcgtcgccgacgaaaacgccaggatcgccattccctaccgcgacctgcccagcaatctggacgtgatcggcaagctgtccgacgagctggccttctacatcggcttcctgtacgccgccttcacgctgccggacgaggagctgaccttccaggatcacccccgtccctacctgacgctgaaatagcgccgctacagcgccaggccgcagtccgcctgcgcgcgcgcccaatcgaaccaggggccggggtcggtcttgcggccgggcgcgatgtgctcgtggccggccaacgccgatagcggcaggtggcggcgcaattccgcgcccagcgccgccagcgtgcggtattgcgcctcgctgaacggctcgaaatcgcagccctccagctccacgcctatggaaaagtcattgcacttctcgcggccgcgccagcaggacaccccggcatgccaggcgcgctgccccaccggcacgaactgcagcaattggccgtcgcggcggatgaagaagtgcgacgacacccgcagctggtggatgccgcggtaatacgggtcttcgtccgggtccaggctgttgccgaacagctgctgcacgccggggccgccatagcggtaaggcggcaggctgatattgtgtatcaccagcagctccggcgcgcagcccgggctgcgctcgtcgcaattgggcgaggcctgctgcagcgcgccgcgcatccagccgtccggggccagcgacaggaccggcggcgcggccggccggtagtccatccgccacagcgccagcccgtccggcacgctccagcgccgctccagcacgaagcccgccttgtggtagagcgcgatcgccgcctggttgacttcggcggtgtcgacgctggcgcgcgtctcgccgtgcaacgcccggttgagcagccggtagccccagccgcagccgaaatgcgcagggtccaccaccgtgcgttcgatgtgcaggccgccgtccagccggcgcgacgccaccaccagcccgcgcagctcgccgccctcgaacgccgccaggatgcggtcgcggcaagaaagcaacgccgccaggtccggccacagcagcggcagcgccggatagtccagccattccacctcgacgcggtgggcggccagctgcagccgcagcgcccgctgcgccagctccgcgtcgccgcggtccaactccttcacttcaaacggcaaatccattctgctcctcgatcgtctatgccccggacggcatcgtacaaatccggcttgtgttccaccgcgcaaagcggtatcaagaacttgcgtcgcgcatcgcgtaagcggccgtcttttccgccgcatcgagtttacgcttgaggcgcatcatgtccacggtttcggcatggcgtcacaatcatgccagaacccacgcaggagaccaccctcatgcttacgctcgacacccttggcggcgccgcggcgcccagcttcgaacagccgctggaaatgctgcaggcctgtcacgacaagatccgccgcttctgcgacaccctggacaagctgccgccctacatcgaagagcacggcgtcgacgaagcggcccgcaacgcgatcaacgacgtggtgcgctacttcgacgtcgccggccccgcccaccataccgacgaggaagaagagctgttcccgctgatcgaggcgcgcgtgcccgccgccgcatccaggctggagcagctggcggccgagcacggctaccttcactcgtgctggaacgccatccgcgacgacctgctgtcgctgcgcgacggccgcatccgccagatcagcaagaacgagctgcaggaattcgcccgccagtaccgcgagcacgccgccgccgaggaggcctggctcttccccgccgccgccagcgcgctgagcgcggaagagctgcgcgccgccggcgcccgcatggcccagcgccgccaaaccggcggctgagccggcgcgctaacgcaaaacgggttgcccgctcgcgccggcaacccgttctttcccgccagggcggccgcttaggccgtcagtttcagcaactgggcgaaagcgtcctcgaacagtttcaggccgtcctgctgcagtttttcgccgacagcggccagatcgacgccggcggcttccacttcggcaagcagcgcctgggccgcgtccatgccctgcggcagcgtcagcgcggcgtcgccgtggtcgcggaaggcggccatcgtcgcgtccggcacggtgttgacggtttcgtcgccgatcaggctctccacgtacagcacgtcgcggtaagccgggttcttggtgccggtggacgcccacagcaggaattgcggacgggcgccggcggcgcgcagcttggcgaactcctcgccgtggaagcgttgctggtagcgggcgtaggctgccttggacagcgcgatcgccaccttgcccttgtgctgctcggccacttgcgggtccagcaggctgtcgacgcgcgacaggaagaagctggccaccgccttgacgccggccaccggctggccgtcggccaggcgcgcggacaggccggcgatgtaggcgtcccataccgcttccacttgcggcagcgagaacagcagcgtgatgttgacgttgacgccttcgcgggtcagcgtctggaaggcgcggatgccctcggcggtggccggaatcttgatcatcgcattggcgcggccgatctcggcccacagccggcgcgcggccgccaaggtgccggcttcgtcgcgcgacagttccggcgacacttccaggctgacgtagccgtcgttgccctggctggcttcgtattgcgccagcagcagatcgcaggcggcctggatgtcggccaccaccagcgtttcgtagcgcgcttcggcggacagcgccgcgtcttgtttcagcacggccagctcgccctgatagctcgcgtcggagctgatcgccttgtagaagatggccggattggaggtgacgccggcgatgccgtcgtcggccagcaggcgggccagttcgccggaggcgatcagttcacgggacagattgtccagccagatacgctggccgaacggacggatggcttgcaaacggttcatggtgaggcgtccgggaattgcttgaggtaaagacagacatcgtagcgcgccgcaaccgccgcgccaagaaaattgtcgcggcggcttgcgctggatcgaagaccgctcaggcggcctggctgtcgttgcggcgttcgcgcgggaacaccacgctgaaggtgctgcccttgtcgggctcgctcttgatttccagccgggcgtgatggcgcgccagcacgtgcttgacgatggcgaggccgaggccggtgccgccgctgccgcgcgaacggccgcggtccacccggtagaagcgctcggtcagccgcgggatatgctcgcgcgggatgccgatcccagtgtcgctgaccgagaagcgcagctgctcgccctcctcctgccaggccagcgtgatgctgccgccttccggcgtgtagcgcaccgcgttggacaccaggttgccgaaggccgaatgcagctcctggccgctgccccacaggccggcgtcgcaacagccggacagcttgacctgatgccgcccctgggacaggccctcggcctccaccatcagcgtgtccagcatgtcgcgcatgtccactttttccgaactcgccgccttggggctgttctccagccgcgacagcgccagcagatcttccaccaggctttgcatccgccgcgactgctccagcatcatcggcaggaactggcggaaggtgcggtcgtccacctcaggcatgtcgcctagcgtctccaggaagccgcccaccaccgtcagcggcgtgcgcagctcgtgcgagacgttggcgacgaaatcgcggtgcaccgtttgcacccgctccagctgggtgatgtcgcgggtcagcagcagcttgcgggtggagtcgaacggcaccagctgcagcgaaatcaccagttcgcgcggctggacgaagttcagcaccagcggctggctgaagctggcgttcttcatatagctgtggaacgatggctggcggatcaggttgaggatctggttgccgacgtcgcgcttgcggtccaaccccaggtgctccaccgccatcggattcacccattcgatgcggtcatgctcgtccaacaccaccacgccatccggcatcgcctcgccggcgttgatgaagcgctccagcacgtgagtcagcttcttcttgctctggctctggttgcgcatggtgcggtacagcgtcatgaacaccgaatgccagacgccgaagccgtccggcacccgctccggcaccggatggcgcagccagcgcagcagcagcgcgatgtggtagaggttgaaggccagccaggcgcccagcgtgatcgccagcgccagcagcgcgtcagtggccgaggacagcgcccagaagccgccgctgacgacgacgatgcccgtcagccacagcagggtccgttgcagaaattcgcgcatcaagcctcactgttgcacggagaagcggtagccggtgccgcgcacggtctggatcaggccgtcgtgctgagtgccctccagcgcgctgcgtagccggcggatgtgcacgtccacggtgcgctcctcgacaaagacatgatcgccccacacttggtccagcagctgggcgcgcgagtgcacgcgctccgggtgggtcatgaagaaatgcagcaggcggaattctgtcggcccgaggtcgatcacgctgccgttgccggtgacgcggtgggtcaccgggtccagccgcaggccctgcacgtccaccgcgtcgtcggtcatctgcggcgcgcggcggcgcagcaccgccttgatgcgtgccaacagctcgcgcggcgagaacggcttggtgatgtagtcgtcggcgccggtttccaggccgacgatcttgtcctgctcatcggagcgggcggtcagcatgatgatgggaatgtggcgggtgcgctcgtcggcgcgcaggcgcttggccacgtcgacgccgctggcgcccggcagcatccagtccagcagcaccaggtcgggcagcgcgtttctgaccagggtcagcgcggcttcggcggtgccggcgcgcagcacgtggtggccagcctgggccaggttgaaggcgatcagctcctgaatcgccggttcgtcttcgacaagcaagatattggcggccatggtcggctatcctcgtttgattgtgtggcaaggatacaaacgcttgatgacagtaatatgacatgtcttggtcagttcccgcgcccggattgtccgcgatccggcccgccgccgccagacaaaaaaaacgggcctgccagatgggcagacccggaatggtcgtcgtcaaaaacgtttgatctgacaagagaccagggacaaagagatcaccaggacagtctcaaatgagggggtcgagcgactcgctcatccgcaaccaatcttggacggagaccgcggcgggacgtgccgctttctccttgatacgggctgcattctacgtagcaaatgccgggccatacccattcattcattggattttttctttttccgccttttttttgatgtttattttgtcatatttcattagaatcgaaacatggacagatttgatcgcaaaatcctcgctgcactgcacgaaaatgccagaatcagcttcgccgaactggcgcgccgggtaaacctttccgcccccgcggtggccgaccgggtggccaaactggagcaagccggcgtgatcaccggctaccgcgcccagatcgatcccggccgggtcggcctgccgatttcctgcctgatcgaactgacagtcaagcatctggagtactacctggtgatcgagcagatccgcaacactcccgaggtgatcgagtgcgcgtccatcaccggcaccagcggcctgatgatcaaggtggcggtggacaccatggcctcgctgcaggcattgatcgcccggctgatgcagttcggcgacaccaagacctccatcatcatcgacatgccggtggcgccgcggatgccggcgctgcagcaggacgactaggcgataaaaaaggccggggccctcacgggcgccggccggaacagagtacaactctcccttacatacttctcaacccgccacgtgccgcacgaagcgcagcatattgcaggtgtagccgtattcgttgtcgtaccaggccaccaccttgatgaaggtcttgtccagcgcgatgccggcgtcggcgtcgaaggtggacggcgcggtgttgccgacgaagtcggtggacaccactttttcgtcggtgtagcccagcacgcccttcagcgcgccctgggacgcctctttcatcgccttgcagatgtcggcgtagtcggcttccttctccagctccaccgtcaggtccaccaccgacacgtcggaggtcggcacgcggaaggccatgccggtcagcttcttgttcagctccgggatcaccttgcccaccgccttggcggcgccggtggacgaggggatgatgttttccaggatgccgcggccgccgcgccagtccttgctggacgggccgtcaacggtcttctgggtggcggtggcggcgtgcacggtgctcatcaggccgcgcttgatgccccagttgtcgtgcagcaccttggccaccggagccagacagttggtggtgcaggacgcggcggagacgattgcctcgccggcgtatttttcgtggttgacgccgtagacgaacatcggggtgtcgtccttggacggcgccgactgcaccactttcctggcgccggcttcgatgtgcttctggcagctttcctgggtcaggaagaagccggtgcattcgatgacgatgtcggcgccgatctcgttccatttcaggttggccgggtctttttcggcggtcaggcggatggtcttgccgttgacgatcaggctattgccttccaccttgacctcgccgttgaagcggccgtgcaccgaatcgtacttcagcatgtaggccaggtattccgggtcgagcagatcgttgatgccgactacttcgatttcaggaaaatccttggcgattgcgcggaacgccatgcgaccgatacgaccgaaaccgttgataccgactttgatagtcatgaggaagtctccttatcaccttgtaatgctcaatgaacgacccggcggcgatccgtgccgcggccgccgagaatgccgattccgtgggcgggcgcccttgccgccaggcggcggactgtggccgccggccgcgccgcggcgcccggaaaacaaaacagcgcaaggccatctcgttccttgcgctgtcactttccacccatttcaccttgtaatcaactcgctacatcaagagttggcgaaattgccgtttcatccttgcaaaacagcggcgtaggggcttgcgtcgccctgcagaatgatatgcagcagcgtggccgaaactgcggtgacgccgctggcgcccagctggcgcagcgcgtcctggtcgacgcggccgctgtcggccacctccacccgcagccggctgccggccaccgcctccaccttgcgcacattgtcggcgccgcccagcgcggccagccagcgcaccttgtctatgctggccccgttggcggctgcggtggacaccagcgtctcggcggcggcttgcggcgcggcggcggccgcgcccagcgcgttgcggatctcgtcggcgatcaggtcggcctccggccccagcaccacctgcacgctgccggcggccgggcggatcagcccgcgcgagcccagcgccttcagcgcggcctcgtccaccttgtcattgctgaccaccagcaggcgcagccgggtggtgcaggcgtcgacgttcttcaggttggcggcgccgcccagcgcggtgatgaagccgcgcgcgcgctcggtgcccttgacgccggcggcgacggccaccgcgccgtcctcgcggcccggggtcttcaggtcgaacttcttgatgaagaacacgaacaggccgtagtacaccacgaagtagaccgcgcccaccggcagcagataccacggatgggtggaaatgccgaagcccagcacgtagtcgaacaggccggcggagaagccgaagccaagcttgacgtcgagcgcgtgcatgatggccatcgacaggccggtcagcagcgcgtggatcgcgtacagcgccggcgccaggaacatgaaggcgaattcgaccggctcggtgacgccggtcagcatcgcggtcagcgccagcgaaaacagcaggccgccgaccgccgccttgttttccggcttggcggtgcggtacatcgccaggcaggccgccggcaggccgaacatcatcaccgggaagaagccggccatgaacatgccggccgtcttgtcgccggcgaagaagcgggtcaggtcgccgtgcaccaccttgccggtggcgtcggtgaagtcgcccagctggaaccagaagatgttgttgaggatatggtgcaggccggtgacgatcagcaggcggttgagcacgccgaacacgaaggcgccgacttcgcccaggcctatcatccagtggccggtgttgtcgatggcgttctgcaccggcatccagatgtagccgagcgccgcgcccaggatcagcgcggcgaagccggtggcgatgggcacgaagcgcttgccgccgaagaaggccaggtagctgggcagcgcgatgtccttgtagcggttgtacagcgcgccggccaccaggccggacagaatgccggacagcacgcccatattgatcttggcgtctatcgtcttcagcaccgcggtgatcaccagatagccgatggcgccggccaggccggaggtgccgttattgtccttggcgaagccgaccgccacgccgatggcgaagatcagcgccagattgccgaaaatggcgtcgccggcctgggccatcatcttgatgtccaagaggtcgggctgacccagccgcagcagcaggccggccaccggcaacacggcgatcggcagcatcagggcgcgccccaattgctggatgccggcaaacttgttcagagtactcacaacatatctcccaggttaatctggcgccgtcttgtctcgcggcggctcaccagcacatcacgcaacgctcctcacccccgcctcaggcggcgggccacaactccactatcctgccgcgcacttcctgcgcggagctcaatcccagcaggcgctcggcctcgctctggcattgccgttgcgacaagccgcgcaccaggctcttcacctccggcaccagccgcgggctgaccgacagctcggccacgcccagccccagcaataccggcaccgcctgcggatcggacgccatcgcgccgcacacccccacccatttgccgtgccgtttggcgccttccaccgcgatggcgatcaggcgcagcaggcccggatgcagcgaatcgatgcgggcggccagcgtggcgttgcaacggtccatcgccagcgtgtactgggtcaggtcgttgctgcctatcgacaggaaatcggcgtgcttggccaactggtcggccagcagcgccgccgacggcacctccaccatcacccccagctgcggccgttcggccaactgcatttccaccgccagctgctcgatgcgctcgcgcagccggatcagttcgccgacgtcggcgatcatcggtaccaggatgcgcagccgcgccagcggcttcaccgccaacagcgcgcgcaattgggtgtccagcatctccggataggcgaagccggcgcggatgcctcttaggcccagcgccggattcggctccggcggcaattgcaggtaaggcacgtccttgtcgccgccgacatccagcgtgcggatgatggcgttgcggccgtccagcgcgtccagcaccgcctgataggcggcggtctgctcggcctcggtcggcgcgtcgcggcggtcgatgaacaggaattcggtgcgcagcaggcccaccgcgtcggcgccgtgcgccacgccttcgcgggcgtcgtcggcgttggcgatgttgaccgccacttcgatcgccacgccgtcctgggtgatggccggcgcgctggccgacgcctgcatcgagcgcaggcgcgccgccagctgctcgatttgcgcgcgcgcggcggccagctcggccgcgtccggctgcggattggcgaggccggcgcgcgcgtccaggatcagttgctggccgtggcgcagcgtcagcgcggcggggccgcaggccaccagcgccggaatgcccatcgcccgcgccaggatggcgacgtggccgctggcgccgccggcggcggtgacgatgccggccaccttgccgcgcggcaggcgggtcaattcggacggcgccagatcgtcggccaccaggatggacgcgtcgaacagctcgggcgcggagccggcgtcgccgtacagcgcgcgcagcagctgccgctcgatgtctttcagatcggccacccgctcggccaacagctggttgcccaggccggccagcacctcgcattgcgcgcggatggattggcgcgcggccaagccggcgctcaggccggcgtcgatgccgcgcccggccgccgccagcagctccggatcgtccagcagagccagatgggcggcgaagatgtcgctctcggcggtggcgccgcggcgcagcgcctcgtctatgccgcgctgaatgtcggcgcgcaccgccgcctgcgcgtccagcagcgcggcgcgttccgcctgcgcgccggcgccgcgctccggcagcggcatgtcgaaagcatccagccgcaccgcctggccgatggccaggcccggcgcggcggcgacgccggcgatgcggcccgccacctggacgacagcggcgctagcggccggcgcgtggccggcgccgctatgggtttgcaacacgcccaccaccgccgccagcgcggcgtcggcgtcggcgccgctggcggctaccgccaccacgtcgttttcggccacccccaggctcatcagcgccaccacgctgcgcgcgttggcctgcttgccgttgaattcgatgacgatgtcggcggcgaatgccttggctgcctgctgcacccgcgccgacggccgcgcgtgcaggccgccctcatggcgcaccaccgcctcgccgcggcgttccgggccgccggcggcgccgcggggggagacatccccgcgggccgccagggtcaggaagcgcgtccggccggcttcgaccaagccttcggcgcggaggggaaaatcaaactgctcggaattggcgatcaccaccatggtctgcagcgacggcgcgcggcgcgccaccgcgtccaggtccacctcgatcagcggctggccttgaaccacgcgctcgccggcccgcaccagtggctggaaaccctggccctccagcttgacggtgtcgatgccgatgtggatcagcacctcggcgccgttgtcggcggtcagcgtcaacgcgtggccggtacgggccaactggctgaccgtcccgctacagggcgcgagcagcgtggacgacagcggctccagcgccaggccgtcgcccgccatcaggccggcgaacaccggatcgggcacttgggacagcggcacggccgggccggtgaacggcgccagcagatctagcgtggtggtcatcgcgattccttgttccattctttttattccgggacaccgcggcgtcccggcggaaaacccgccccgctcagcgggtgcaggtgactttggacagatggcgcggcaggtccggattcaggccgcgcgcctcggacaagcgcgccgccatcaagtagaagctctggatcgccagcagcggatccagcgcctcgtcgtcggccagcgccagcgtcaggtcgcggctggcgacttcggccggcgccgccagcaacaccttggcgccgcggccgcgcatctcggccgccagatcgatcaggccctgctgttccgggccgcgcggcgcgaagatcagcagcgggtagccgtcgtcgatcagcgccatcgggccgtgcttgatctcggcgccggagaaagcctcggcctggatcgcgcaggtttccttgaatttcagcgccgcctccagcgccaccgcgaagcccaggccgcggccgaccaccatgatgcgttcggccggctgcagcacttcgatggcggcggaccagtcctggacggcggcttcggtcagacgctgcggcagattttccagcgcggccagcagcgcctcgtcggcatgccagtgcgccaccaggcgggcgacggcggacagcgcggtgatgtagctcttggtggcggcgacgcttttttcctcgccggcacacagcggcaccgcccagtcgctggcctcggccagcggcgactgctgcttgttgaccagcgccacggtgtgcgcgccggccgcggacagcgccttgacggtgtccaccaggtccgggctttggcccgactgcgacacggcgaccgccaattgcccttccaccgccagcggcgcgcggtgcagcgtcaccagcgacatcggcagcgacaccaccggaatgccgaggcgctgcatcaccaggtaggcgaagtagttggccgcgtggtcggaactgccgcgcgccaccgtcagcgcgagcttaggcgcgatgcgggccagctcgcgccccagcgcggccaggccttcatcggcgtacatatgttgcgcggacaccgcctcggcggcgtacagcgcttcttcaagcatcaacgaggccaatctcttctccctctacgtagacttgctgcaaattcaggtcggcatccagcgccacgatgtcggcccaggcgccgggggccaggcggccgcgctcggacaagcccaggtagtcggccgggtacagcgacaggcggtggctggcgtcggccagcggcaggccgatcttcaccaggttgcgcagcgcctggtccatggtcagcgtgctgccggccaaggtgccgtcggccagcctcaccccgcccatgcatttggtcacggagtgggagcccagcttgtactcgccgtccggcatgccggcggcggcggtggaatcggtcacgcagtagaggcgcggaatggcgcgcagcgcggtgcggatcgcgcccggatgcacgtggagcaagtcggggatcagctcggcgtattcggcgtgcgccagcgcggcgcccaccacgccgggctcgcggtgatgcaggccggtcatcgcgttgaacaggtgggtgaagccggacgcgccctgctccagcgcctccaccgcctgctcgtagctgcccagggtgtggcccatctgcacccgcacgccttgcgcggacaacgtgcggatgatgtcgagatggccggggatttccggcgccagcgtgatcagcgagatcggggccagcgcgcggtaggcgtcgatttgcgccatcgccgcctgacaggcgtcgtcgggctgcgcgcccagcttgcccgggttgatgtacgggccttccaggtgcacgcccagcacccggctgcccgccggcgccctttccttgcagttgcggcccagatcggccagcacgcggctgatttcctccggcggcgccgtcatggtggtggcaagcaaggaggtggtgccgaagcgggcatgcagccgggcgacatgggagatggcgttgccgccctccatgatgtccaccccgccgccgccgtgcacgtgcaggtcgatgaagccgggcaggatatagcgttccggctgccggccagacgccagcttggcgtctatctctgcgatgcggccatcggccgccaggcgcacgacgccgtccatccacccggaggcggtgaggatgcggccctgcaaggtcaggttctgggtcatcgtttcagttcggctacaaaatcgtaataatcgttgcggcagtaagtgtcggtgagctcgatcgccacattgtcggcattgaagccgatccgggtgatcagcagcatcgcctcgccgggccggatgccggccagcgtggcgacgtcgcccgaggcgttcaccgcccggatgtgctgcagcgcgcgcaccaccgaatgtcccgccgcgtccaggtgggcgtataaagacgtgcccaccgcctgcggatccggcagatacgccaccggcatcgtgctcatttcaatcgccatcaccacgccgtctgccagccgctgccgcttcagccgcgccaccatcgaggtcggcgacagccccaggcggatcacttcctcgttgctgggcgggaacacgccgcgctccagccacaccgacgacggcacgaagccgcgcagccgcagctgctcggtaaagccggtcaagcgcgacagcggctgctccagcctgggcgtgatgaaggtgcccgagccctggcgccggcggatcatgccctgctccagcagcacatccatcgccttgcgcgccgtgacgcgcgaaatgcccagctcttccgaaaacgtccgttccgacggcagcgcctcgtccgcctgccaccagccggcgttgatcgcatcggccagtttgcgcgacagctgcaggtacagcggggtgctcaggttttcatcgggtttcaatgccagccagcggttttccatggtcgtctgcaagtggtctgaaaattgcagtgtaagcctagtcttccgcctccggtatcccgcagccgccgcaatggctggcttaccctgcggaagttaataccacattaataccacgtcaataccatttgtcagatcatcgccgcttaatatcggccgcatggcaacaaaacgacagcgcgcggattcatggcggggaaaagtggaaatttggccagggagaggcgggaacgcaggactggcgcggcgcgatctttgcaagaatcaagccagcgtggcctcacggccagttggccgtcattaataccagtttgtaaacttgcatttaaaatttgcatcaaattttaaatcgccaacttgttttggcgtactggatcagtcccgctgatgactgtgcatttgcataccactacaacaaggagcttgtaatgaaactgcattggcaactccccgccgtgatgacgctaagctgcctgagcgcgccgctatgggcgcatggcaccatggaagttccgatcaaccgcacttacagctgcttcctggaaggcccggaagcgccgaagaccgccgcctgccaggcggccaggcaagtcggcggcacccaggcgatgtacgactggaacggcatcaaccagaatccgcagggcgacaaccaccaggcggcggtgccggacggcacgctgtgcggcggcggcaaggccgaattcaaaggcttcaacctggcccgccgcgactggcgcgccaccagcatcgtgccggacgccaacggcaattacgaattcatctacaaggccaccgcgccgcacgccaccaagtacttcaagttctacatcaccaagaacggctggaatccggacctgccgctgaaatggtcggacctggaactgttcggcaccgtcaacggcaatccgcagcaggacgccgccaagcgctaccacatgacgctgaagctgccgcagggcaagaccggccagcacatcatcttcaacgtctggaagcgttccgacagcgaggaggccttctactcgtgctccgacgtcagcttcggcgacgccgcgccgccggccgccaatccgtggaaggaaatcggcaacgtcgccgcgcgcgaaaacctgccggccggcagcagcgccacgctgcgggtgttcgacagccagggccgcgacgccgagaagcacacggtggcgctgaacgccgccagcggccaggccgccaactggccgtacgcgctggcgctcaaggtcaacgccgcctcgccggccatccgcatcggcgtgctgaaatcgcagcagcgcgccgtatccatcgtgccggtgaaggatgccaccgccaaccgcgtctacctgaacgacagctacaagggctacagcttcgcggtcgatctgaagaagggcgacggcggcgcgacgccgcccgccgccaacgcctggcaggaaggcggcaaatacgcgaccggccaggtcgtcagctaccagggccgccagtaccgctgcctgcaggcccacaccgcctgggccggcgccggctggacgccgtccacccaggccacgctgtggcaggcgctctgacgctccgtccatgaaaaacgccgctccgaagagcggcgttttttcgtcatttgcgccagctgatcagcaccaccgcggtgacgatcaccaccatcgccagcatctcgtggacgccgacccgctcgccgaggaacagcgcgcccagcagcaccgcgatcaccggattgacataggcgtagctggtggccgccgccgccgataccgtcttcagcaggtagaggtaggcgctgtaggcgatcatcgaaccgaacaccgtcaggtacagcagcgccccccagccttccacgccgggccaggcggcgaggcgctcgccgacggcgcagctcgacgccagcaacgccaggccgccgaaaatcatggtccaggcgctgcccatcgcgccggccggctgcggcagcttcttgctccaggccgagcccagcgcccagccggccgaggccaggatcagcagcgccgcgccgcgcgggctggcgctgaggctggagcccaggttcaacagcacgatgccgcatacgcccaagcccatgccggcccactccagcggccgcgagcggtggccgaacaagcgggcgaacagcagcgtgaacagcggcaccgtggcgatcaccagcgccgccacgcccgacgacacctcgcgttcggccaccgtcaccaggccgttgcctatcgccggcatcagcacccccagcagcgccgcgccgcccagctggcgcgcgtccggccacggcgtccgcttccacgccagataccccagcaccaggctgccggccagcaaaaagcggatgccggccatcaacagcggcggccaggattcgacgccgatgcggatgaccagataggtggagccccagaccaggtaaagggcgaggaaagcggccagcgtcagcggcgcgagacgtgaaaaaggcatggttcgatccgtaaattccaagatcaaaccatgccggatgcaagccgaaacggcaagggtcttaacgcgtcgccagccgctgcaggatgttggagaactcttccatataggtgtcgaagcgggtggccaggcggtcgacgtcggtagcgaagcggttgtaggccaccaccgccggaatggccgcgaacaggccgatggcggtggccaccagcgcctcggcgatgccgggcgccacggtgctcagcgtggcctggccggcgttgcccaggccgatgaaggcatgcatgatgccccacaccgtgccgaacaggccgacataggggctgaccgagccgaccgtcgccaggaaggaggtgtggctgtccagcgtgtccagctcgcgctgcgccgccgcccgcatcgcccggcgcgaaccgtccatgatgtcggacagctcggcgccgccgcggccgcgctgcttgagaaattcggcgaagccggactggaagatgcgctccatgccggcggtgtcgctgcggcggcacacgtcttcgtacaggcggttcagatccgccccgctccagaagttgcgctcgaactcctcgctgtggcgcttggcggcgctcaacgccgcgatcttgctgaaaatcagcgcccacgacagcagggaagtcagcgccagtcccgccatcaccagctgcaccatcaggctggcgttcaggatcaggctaataaatgaaatctgttgcacggcgttttcctcaattcacatgcggcctagcgtaacacgcggccgctttccagatcgatgatggtggacggtttgcgacgcttgccgatgcggcccggcaaggtcagcaccctgtccttgaaggccatgcgacaggcgcgcgcccgcttcagcgatttctgcccggcgcggttggccgaagtcgacaccagcgccgtccccaggctgcggcacagcgccgccgcctcgccgtgggcggtcacccgcaccgctatcttgtcgtgccggccgcgcagcgccggcggcacccgccgcgacgccggcagcaaaaaggtatatggacccggccaatggcgttccagttccgcgcgctgcgcggcattcagcggcttgaccagatggcggatctgctcgaaatcggcggcgatgacgatcaggcccttgtgattgggccgcgccttgatcgccagcacccggcgtatcgcgcggacgtcgagcggatggcagccgaggccgtagcaggattcggtggaataggcgatcacgccgccatggcgcaattgcgcgcgcgccctttgctgcaggcgtctgcctggcagacgcggcaaggggctggaaccggacttcatgattgatcggatcggaacgaaaacgggaagccgccattgtaccggcaacggaggaaaagcacaggcgggaattgagcgcgaacagacggggaaggaacaccggaatcgactacaggccatcgtccgactccggtgtcgaaccatgcctcaatgcaacagcaaatcctcgtggtcttcggggacatcttccggcgcggcgcgccaggcataacagcgcggcggcgggccggcttcggtgttgaactgcttcagccagtaggccaggcggcgccagcaacggcgctcgtgcgtcaggaaatgcatcaagcggctgcgacttccaggctccggttctgccggcaggctggcttcattgtcgggaacatacatggcgacaccccttgcgaaatgccggatgggcatgctgtcaatgtatgtcgccggacatcaatccttcatctaaatcgcgcgccagcgcatcaaaatcgcataaaaaccagccggcgcgaaagaaaacagcgcctgatggcgctgttttccctacggcggcgagacgctcagaccttgcggcctatcgcccgcgcgccgatgtcgcggcgatactgcttgccggcgaaatcgatggcgtcggccaacagataggccttgccctgcgccatcttgacgctgtcgcccagccccaccgcgcacagcacccggccgccgtggctgcgcagctgctgctcgccatccagcgcggtgccggcatggaacaccacgccgtcgtcggtctcatgcggaatgccgtggatggcgtcgcccttgcgcggcgcgtccggatagccggcggcggccagcaccacccccagcgccacgcggcggtcccattcggcctccaccttgtccagccggccgttgacgccggcttccagcagcatggtgaagtcggttttcagccgcgccatgatgggctgggtttccggatccccgaaacggcagttgaactcgatggtgtgcggcttgccgtcggcgtctatcatcaggccggcgtacaggaagccggtatacggatggccgtccttcttcatgcccagcacggtggggttgatgatttcgcgcatcacgcggttatgcaccgccggcgtcaccaccggcgccgggctgtaggcgcccatgccgccggtgttcgggcccatgtcgtggtccagcaagcgcttgtggtcctggctggtggccatcggcagcacatgctcgccgtccaccatcacgatgaagctggcctcctcgccctgcaggaagtcctctatcaccacgcggctgccggccgagcccatcttgttgcccagcagcatgtcgtcgatggcggcgtgcgcctcgtccagcgtcatcgccaccaccacgcccttgccggcggccaggccgtcggccttgatcacgatgggcgcgcccttgtcgttgacataggcgtgcgcctcggtggcgctggcgaaggtgcggtaagcggcggtggggatgccgtggcgctgcatgaaggccttggcgaaatccttggagctttccagctgcgcgcagtactggctggggccgaaaatcttcagcccctcgctgcggaaggcgtccaccacgccggccgccagcggcgcttccggccccaccacggtgaggtccaccttttcctgtttggcgaaagccagccaggcgtcgacgctgttgagatcgacattggtcagattggggtcaagcgcggttccggcattgcccggcgcgacaaacaccttggacacgcgcctggatttggcgatgcgccaggccagcgcgtgttcgcggccgccggagccgatcacgagaactttcatgggtgagatcctattttgggcggacggcggcctgctggccgcccgtctacgccatcactcggcattacctgaatagcataacgccaagcttgtttcattgccgccgtttccgtcgcggccacggcggccgcggcctgctcagtggcggaaatggcgcacgccggtcaacaccagcgcgatgccgtgctcgtcggcggcggcgaacacttcgtcgtcgcgcatcgagccgcccggctggatgatggccttgatgccctgttcggcgatcacgtctatgccgtcgcggaacgggaagaaggcgtcagacgccgccaccgcgccggccaggctcaaaccggcgtcctgcgccttgcgggcggcgatgcgggtggagtcgacgcggctcatctggccggcgccgatgccggcggtctggccgttcttgcaaaacacgatggcgttggacttgacgtacttggccacgcgccaagcgaacagcaggtccgacatctcctgcggcgtcggctggcgcttgctgaccacgcgcagctcttccggcgtcacgttgcggatgtccggcgtctgcaccagcacgccgccgccgacccgcttcagttcgaagcggttggcgccggtctccagcgggatttccagcacccgcacgtttttcttggcggcgatgatggccttggcttctgcggtgaaggacggcgcgatcagcacctccaggaactggccggtcacggcttccaccgtggctgcgtccaccgggcggttgaaggcgatgatgccgccgaaggcgctggtggtgtcggtggcgaaggccagcttgtaggctgccagcgtatccggggcgaccgccacgccgcacgggttggcgtgcttgacgatgacgcaggcggtgtcgtcgaaagtcttcaccgcctcccaggcggcgtcggcatcggcgatattgttgtacgacagctccttgccctgcagctgccggtagtgggcgatgctgccggcggccgggtccaggtcgcggtagaaggcggcggcctggtgcgggttttcgccgtagcgcatgtcctgcaccttgatgaactgggcgttcaggcggttcgggaaggcgacgcgctccggcttgcccgccaccacgccgtcggccaggctggtcaggtagttggagatggccccgtcgtaggcggcggtgtgggtgaacgccttcttcgccagctcgaagcgggtggccttggccagccggccgtcgttggccttcatctcggccgccagcgccgggtagtcggcgctgtcggtgacgatggcgacgtgcgcccagttcttggcagcggagcgcaccatggtcgggccgccgatgtcgatgttttcgatcgcgtcctccagcgaacagtccggattggcgatggtggcttcgaacgggtagagattcacgcacaccaggtcgatgttgccgatgccgtgctcagccatggtggacacgtgctcgggcaggtcgcggcggcccaggatgccgccatgcaccttgggatgcagggtcttcacccggccgtccagcatttccggaaagccggtgtagtcggacacctcggtcaccggcaggccggcgtccagcagcagcttggcggtgccgccggtggacaggatgtgcacgcccaggcttgccagctcgcgggcaaattccagaacaccgctcttgtcggacacgctgatcagcgctcgttcgatcttggtcatgattctctaccgctttggctatggataaacacgaaaaaaccggtttggtcgggctgccgcgcaacccgtcccgctggcccggccccgcgccggggccggacaaaaaaaaccggccattcctgggtaggcatggccggttatcttcaaatcaaatcatacgacttcatcttcttgcgcagcgtgttgcggttcaagcccagcaactccgccgctcgcgtctgattgccctgggtgtgtatcagcaccacctccagcagcggcttctcgacacaggcgagcaccatgtcgtagatggcggacggcgcctcgccgtcgagatcgcggaaatactgctccatcgcaatccgtaccgactgcgcgatatgttcgttgttttgcatgtttattattggtgtccagatttcggggtccccaggaagcccgtgccgccatgcctcggtttcagtcagcatagccgcaggcctctccctccacgccggcttcccggtcgtggtccatcctgtctgcatcctcggccaggtaaaccaggcgatcggattgctcgcccagccgtgcaaaatagtccgccaccgccagacgctgctcgtccgtgctctccagccggtacatctgctggcggaactcgttgctgccggccaggcccttggtgtaccaggcgatgtgcttgcgggcgatgcggcagcccgaatattcgccgtaaaaccggtatagctcgtccagatggcccagcagcaagtggcggatttcctccacctccggcgccggcagcgtcgcgccggtgtccaggtaatgctggatctcgcggaagatccacggccgcccctgcgcggcgcggcctatcatgatggcgtcggcgccagtgtagtccagcacccggcgcgccttctccggcgaatcgatgtcgccgttggccaccaccgggatcgacaccgcctgcttgaccgcgcgtatcgtgtcgtactcggcgtcgccgcggtacatgtcctcgcgggtgcggccatgcagcgccagcgccgcgatgccggcgttctccgccatccgcgccacctgcagcgcggtcttcgcctcgcggctccagccggtgcgggttttcagcgtcaccggcacgtccaccgccttcaccaccgcctccaggatgcggccgacattgtccagatcgcgcagcaacgccgagccggccgccacattgcacactttcttcgccgggcatcccatattgatgtcgatgatctgcgcgccgtgctcgacattcaggcgcgccgcctcggccagcatctgcggatcgccgccggcgatctgcaccacgatgggctcgacctcgccttcgtgatcggcgcggcgcagcgttttcgcggtggtccacagggccttgttggcggtgatcatctcagacaccgccatgccggcgcccagccgtttgcacaacatgcggaaaggcctgtccgtcaccccggccatcggtgccacgatcagccggtttttcagttggtagggacctatctgcatgacagtttcaatacgggtaagggctgggaagggtcggtattgtatagcgtttcgcccggggcgggaaaaatttttgcttattttttaggcagagtcgatagccgcgagtaatcggctgcgggaatggggtggaagtcagtcgataagccgggttctgtcgttggacagtcattcctctagacctgccgttgccgacaggttcaagcaacctacccggggacaacgcgagccgcgttagcgcccccctatttggtcttgctccggatggggtttagcctgccgtccgtgtcgccacgtccgcggtgcgctcttaccgcgagcgggttgccccgcccgtccgggccggcttgcgcctcccggtacaccttttcacccttgcctgatccgcccttgcgggtttttgtcgggacaagccctccaaaaagactttgtcgaccttgcggtcgacaagtccggccatcggcggttcagctctctgttccactttccgtcgcctcgcggcgcccggtcgttaaccggcatcctgctctatggagcccggactttcctccccgcccttgcgggcgcggcgactgtctgactgacttccggccgcgattctaacggaaatccgccggcgccgcccgacaatctttcatgacattcaggataatcccgtatactgaccatcccttttcgaagtcccgagaccgtgatggagttgaaccaagccaggctgtcgcgcttgcagctgttcggcaccctggccatcgtgtttgcgctggccctcaccctgaccagctatttcctgatgatgagctggcacgatttccaatccggacggcaaaacatagagcaagaggcctccgcgcgcgcgcgcgacaacctgcgggcctataccgaccacgccgcgctgctgctgtcggcgctgcgcgaacgcaccaacgacaccgtccgccaccagctgcaggagcaggtggaccaggcctggagcctggccgacgccatctggcgccgagaacacggccgccgcggcgaacaggacgcgcagcggctgatcgtcgaggcgctgcgcccgctgcgctacttcaacggccgcggctacttcttcatcgacaccctggacggccgctgcgtgctgctgcccaccgcgccggcgcgcgaaggcacctcgctgctggccaaccgcgacgaccgcggccgctacatcatgcgcggcctgatcgactcggtggccaacccagacggccgcggcttctccgcctaccgctggtatctgcccggcggcaaccgcatggacgacaagatcacctatgcccgccgcttcccgccttacaactggctgataggcagcggcgaatacatcagcaatgtggaagccgcgctgcagcagcagggcctggacacgctggcgcggatgcgcttcggccaggacggcggcgaattgatgatcatcgaccgccagggcgtgatccgcctctatccgacccggccgtcgctggtcggcaaatcctaccagacgctgccggcggccgagcgcgaccgcgcgctgcaactgatccagcgcggcaagcacggcggcttcctcgaatacagccgccaggacgaggccggcgccgccgccgaatcctatctcgcctacacccgccagctgccgggctgggactggaccctggtcaccagcctgcgggtgcagacgatacaggacgacggcctgcgcgccgcgcagcggctgaaaagcaggctggccgagcgcatcatcgccacgctgggcatgacgctggtggcgatgctgtgcgccggcctgctgtgctggtatttcgtgcgctgggtcagcgcgctggtgcggcgctaccagcacgatctggcgcaaagccacctgtcgctgaaggagcaggcgcgcgaactgaagctcagccacttcatgatcgacaacgccaccgacctggtggcgctgcaaagcagccagggcgaggtggtgtactgcaacctggcgctgcgccgcctgccgcagctggtggacgacctgttccgccatccgcccggcgccttcccgctgactttcgaaacccgccacgacggcgacgacggcgagctgttcctggaaatcaccgtcaaccagctgcgctatcagggcgacagctatctgtgcgccaccgcgcgcgacatcagcggccgccgccagaccgagcgccagctgaggctggccgcccaggtgttcgaatccagcaacgaagccatcctgatctccgacccggacaaccgcatcctcaccgtcaaccgcgccttctgccacatcaccggctacagcgaggacgaagtgctgggccgcaaaccatcgctgctgttctccggccgccacgagcccgccttcttccagcagctgtggcagaccctgcgccagcgcggccaatgggccggggaaatctggaaccagcgcaagaacggcgaacacttcccctgctgggtcaacatcagcgtgctgcaggacgcgcagggcgcgatcagccacttcgtcgcgctgttcaccgacatttccgaacgcaaggagcaggaggcccgggtgcagcacatggcggaatacgacgcgctgaccgacctgcccaaccgcgtgctggtcaacgaccgcctgcaccaggcgatacgccaggccgagctgcagcacaaccagctggcggtgctgttcgtcgacctcgaccacttcaagaacatcaacgacacgctgggccacagcgccggcgacgaactgctgaaggaagtggcgcggcggctggccggcgcggtgcgcggcctcgacaccgtcggccgcaccggcggcgacgaattcgtgctgatcctgccggcgatcaatcagccgagcgaggcggcgcagatcgccgaacgcatcctgcgcacgctacagcagccgttccagatcggcgagcactcgctggtggtcagttgcagcataggcatcagcctgatgccggacgacggcagcgacatccagaacctgctgatgaacgccgacctggcgatgtaccacgccaaggcgcacggccggaacaccttccgcttctacacccgcgagatgaacacccaggtggcggagcggctgttgatggaaaaccggctgcggcgggcgatggagcagcagcagctgtacctggtgtaccagccgcaatacgacatggccggcaaccgcctgctgggctgcgaagcgctgctgcgctggcgcgatccggacgagggcctgatcatgcccggccgcttcatcccggtggcggaagacaccggcctgatcgtgccgctggggcgctgggtgctgaacgaagcctgccgccaggccagccagtggctgcgcgacggcctggggccgatccgggtggcggtcaacgtgtccgcccaccagctgatgcgccacgacttcatcgacgacgtgcgcgacgcgctgcagaagaacagcctgcccggccactgcctggagctggaggtgacggaaagcacgctgatggccgacgccgacctggcctcgcgccagctggcggtgatcaaggcgatgggggtgcggctgtcggtggacgacttcggcaccggctattccagcctggcctacctgaagcgcttcgcgccggacacggtgaagatagaccgctccttcatcaccgacctgcccggcgacgaggaaaacgccgccatcgtcagcgccatcatccacctggccggcgcgctgggcatggaaacgctggcggaaggcgtggaaaacgaaacccagcagcacttcctggaaacgctgggctgcgaggcgatgcagggctacctgctgggcaccccgctggccgaagaattgatgacgcggcggctggaggcccagcaaccgctgcagccggcctagccgccggcaggcgtcacagcgcttccagctgcgcctggtcaatgatgccggcgatggccgccagctgcttcatcgacatctggtgttcgtcctcattggccgccgcgcaggccggctccagcaccagcacccggtagtcgcggtcgtgcgcgtcgcgcgccgccgcctgcaccgcccaggtgctgctgacgccggcgatcaccagccgctcgacgcgctgcgcccgcagcaccgcctccaggccggtggcgtaaaacgggctgatgcggtgcttcaccaccaccgcgtcttccagcgccacatccagctccggatggaaatcggtgcccggcccggccaggttcagcgcctgcagcgcctgggcgcggctgaagatggccgatccctccggcatttcggcgtaattcggcgaaaaccccaccttgacatggatgatcggccagccctgccggcgcgccagcgcgatggcgcagttggccgccgcgatcacgccgcgctcggcggcatggccggcgcagcgcgccgtcttgcccgtcgggtgcatgatgtcgatgatgtagtccagcgtcagcagcgcggttttcatggttcactctccgaatactctcgatcgcggcggcgaagggccgccgccctgtcaatcctcgcgcgccagccgctccagcaaggcgccggcgcgcaacagcagcgcgcggtcggcgtcgcccagtccatccagccgcgcctgcagccagccatcgcgcagctggcgattgcgctgcaaggccgcggcgcctgccgccgacaactgcacgcgcacccgccggccatcctccggatcaggcaggcggcgaatcagcccgccgccctccaactcgcgcagcagcccggccagattggacgagcgcaggctttcgccgcgcgccagctcggtgggcgtcgcctctccgccggcgcggtctatcgcgcccagcaccgccagcaagccgaaaggcagcacatcctggctcgcctgctggcgcagccggcgcgtcatcgtcatcagctgcatccgcagccgggtcgccgcggcgatgtgggcgctattgtctttcatcatttatctactattacatagctattcaattatagcaattttgccgaaaaaggccccgaggaagccaggcccaggccgattgcccagcggaccgtcacgccgccggcagacggtccgtacccatcatgccctctgcgtcgccacgtgctcgccggccttcagcatcgcgatcttcacatcggcgaaattcaataccctgtaagccaggcccagcgccagcaactcaaccagataatcgcgtccgaaaatggccgcgccctcccagtccgaccccttctcgcccaagatggatggacaagtcaccaggacgcgcttgccctgtatcgtgtccaaggcgaaatcatcgtcctctattctctgaaccagatgtgttgatgccatctaatgccacctcaactcgataactcatcggagcagacgccgcgccaggccaaacatccacccggcgcggcatccgattgcttacacacgcgatactcaaccaccgtcaaacatgccaatgtcaatcaatactaagacaattccaacactacctacttgtctctgcaatagacagcccagtcatgaccaaaatggcgtctcgcggcttggccatcccgaccttcgctcgacaggcatacgatatcaggcaaattaatctcaatgccataaaatttgcaatttacgcacacaaaaaaataaaaatgtgcgctttacgcaatcggcaaccaagccatgtcatggcaaatttgtagcatcaatgatttgctgatagcatttcgacccgccaaccgcagacgaaaatgccgacatgatcgacgacttcaagtcatatttcctgggccgcctggcccagctgctagagtcgcgcggcattgcggagcgcgaacgcacgctgtggctgaagaccctgctgggcatcgacctatccagtgcgaatcgcaaattgaagggcggaatcgccttcaatatcgaagaactggccaaggtatcccgggcggtgagttgctccagcgattacttgcttggcctgaaagacgaagcctccgctacccgtccgcccggccatgccttcgatggccttggcgtgcgcgccacgctggactgcgaccggttgcccgcgcaggacaccatgactgtcgcggctcgccaccttggcgaccctgatgaaaaagcgttgattgcctggatatcgcgcaatgagagtgcgctaaacgcacaagttgtcgcctggaagcctgtcggcggcagcggctggaaaatggcggaacgcgcggacgcgccttccgatgcgaccttgcaccgggtatacgcgcgcctcgcgctggatcccgccatcagcgcctaccggatcgcggtgctggatgatagggccgaaacggcggaagtgatgcaaggctttctggaacaggccgggtacatcgccgacacctacacccggacagacgagctggccaaagcgctgcggcagacccgctacgacgctttcgtgctggactggtcgatgggccgcggcgaaaccaccgaatcgctgatggaagacatccgccagaaccatgccgccgacacgccaatcatcctgatcaccggcgaagccagcgaactggagatagaacgcgccatcgaccgccacggcgtgcgctactttcagaaaaccgggctgttcaagcccatcatcgcccagttgaaaaaggatttgcgcgaattggcttgaaaccgatcagaccagctcaaccggcagtctggcgatgaaggtagaccccttgcccacttcgctgccggcgagaaacacctcgccctgcatcagtacggcgatcttgcggacaatcgccaaacccatgcccgcgccgccgcgattggcgcccttggcttgggtaaaagcctcgaacagacaagcctgctcgctctcggggatcccgatgccggtatcactgaccgttagcgtcagacaggctcgcggcgcgacgccctccaattccaacgccacccgcacctcgccggcgtcggtatagcgcaaggcgttggagatcaaattgctggccacttggcggattctggtcatgtcggcatgcgcctcgaccccggccacgcccgccgcggcaaaagacagcgccacccccttggccgcggcgacctggcgaaactcccccaccacgctgcccagcagctggccgggctcgaaccgcgtcggccgcaaaatcatccttcccgcgtccagccgtcccatatccagcaaatcctgcatcagcttggacaggtagtcggcggcagtcctgacattggcgatcgtccgcaacaccctgggctcccgctccatgtcggacaacaactcgaccccgccctgtatcgtgtgcagcggcgtcaggatttcgtggctgacggtagacaacatggtggagcgcgccagcgccgtctgcaccgcctcttcctgggcctgcttggctgcggcgatcatctcgcgctgcagctcaatgatctcctggcgccgtatcgccttccatagctcccgcgccagaaacaccaccagcaccgcccagatgatcaggctgaccaaggcgaaattgcgcagcctcagcgtctgttcgatcgatgcatcgcgcagccggacctcttcgtgatgagcggctatcaccaaatcggcgatcaccggcgacatgtcgttcaactcctgctgcagcgcggccagggcggcggcatcgctccgcgtcgccggaaacaggatcttgccgcgccgcatgaagccggcgatctgctccagcaaggccgcgtaatcggcgttcttgcgcaattgcggagaaaccgagcggttcagcaccaggtattttgattccagcacatcgtaggcgacctgcaaatcttcaaaggtttcgatatgcagcgcataagcgttgatctcgccatacaggcgctgcaccgcgtaccgatattgcgatgccgcccagtaatagccctcccctgggcccgcggcctgctccagcgcctgcttggaaaacagcgtgctttgcacgtaaaagaagcacaacatcggcaacaagaccgccaggcagaaaaacatcagccactgccgcccctgctgcaccggaagcggaattctcatcaacgcaccacgatggtcttgatttgccaggcaagcttggcgtcggctttgactttctgcaattcggcgaaatcgctgaccggatacatcatccacagcgggccgaaatcccgcctctccaacggcttgccattgatgaacctggccatgatgggatggtatttgtccagatcgctcagcggcaggatcactttgtattcatcgtaagtgaccagttctatcttcgaaccgcgcgcgccgaccgcgcgcagaatgtcgctgagccctgggccggaaaacaccgacctcggcgtccaggtggttcgcgtggtgatggtgcgctgcggcaagcgcaacagctcgctttcggtgaagcggtattcgctgcggccggcgtcgttgaacatgcctgctccgcccctgaccgtcagcatgacatcggcgggcgaggccatcgccgcgccggaccaggccagcagcatccccgccagcaatcgtttcattccatccctcatttcgcctcccgccgattcattactccgtcgtaaagacgaactaccgacaagcctatcatcatgaatccagggtggcgatgcccaagccgcttatttgccgactatcaccaccgtgcaagtctgcccggcgatcagcggctggccctgcggctgctcgtccagctggatgcgcaccggcacccgctgcgccagccgcacccagttgaacgtggggttgacgtcggccagcagctcgcggccggtgccggcgtcgcgatcggtgatgccgcgggcgatgctggcgatatggccgcgcaggcgctggccgctgctcatcagcgtcacctcggccttggcgcccaccttcagcatcggcagcttggtttcctcgaaatagccgtcgacatagaaagagccgccgtcgatcagcgccagccggggcgcgccggtggctgcgaagtcgccgacatggacgttgaggttggtgacatagccgtcggtcggcgcgcgcaccaccgtgcgctgcaggttcagcgcggccagctcgcgcgcggccaccgccgcctggtactgcgacaccgcggcggcggcggcgaaatcggcgctttcgcggctttcggtggagacgatggcgctgtccaggctggcgcggcgcgccgcctccttgccgcggcggctcttgtcggcctggtggccggccagcgtcgcctcggcctgcgccagcgccgcgcggtagcggctggggtcgatgacgaacagcacgtcaccgcggcgcaccggctggttgtccttcaccgccacctgggtgacgatgccggacacgtcggcggcgatggtgaccacgtcggccttcaccctgccgtcgcgggtccacggcgacagcatgtagtggtcccacagcgtttttccggcccagacggcggcggccagcaacagcagggtgatcaggtagcgggtaatcgatttggcgatcatggaaaagaatccggtaggcattgtcaacggtaaagcggcagcgccagcgcgctgaaaatcacgatcagcaggcaccagcggaacagcgccggatgccacaccttctcatatacccccagccggcccagcgcccagtccaggccgatctgcagcagcatgcccaacacgaacaagggcagcaaggtcggcatcaggatgccgaatacggcgatttcatgcggcatggccgtctcccgccggcgcgccggcttccggctgcggcatggcgtccagcagcgaagtatggatcagatgcagcgtggccagcgcccggttcaggctggccgcggcctccggcagcgccaccgccagctgcgcgcgtatcggcggccccgccgccagcagcgccgccatcgcccgccgcaattgcggcggctgcggcgcggcgaaatagtcggccagcgccgccacgctggcatcgagcgcgcgccgcaccggctcctgcccggcgtcgcgggccagctggcgcagatcgatgatggccagccccaattcgagcaaggtgatcgcctggctgatggtggcctggcgcgccggatcgccggcctcgcccggcgcggcgttcaattggttcagcaggtcgcgcacgcggttgccgtagcgctgcttcaggtgcggcaggccggcgcggcaggcgttcagcgcctcgcgccacagcgccgcggcgatgtggcggcgcgagcccatggtgtgctccggcagcaccagcacgaagaacatccccgccagcgccaggcccagcaggcgggcgatgccgtcgttgagaaaggccaccacgtcgtagctcatcatgttttccgggttcaccgcctgcgccatcaacagggtgatgccggtgccgacgccggcggttttcggccagcatttcaggtagcagcccaaaaccaggaagggcgacatcgccagcgccaacagcgcaaagctgtcggcctggttcaagagcttgaaggtgcagacgtaggccagcggcgtggccagcgcgaagccgaccaggatctgcttcaccatcagcaagggccgcggcgacgacgaggccaggccgcagaagatggtggccagcagcaccgcgcccagcgcgctgggccaggccagccagtaccaggcgacggacagcgtcaacagcgtcagcgccgcccgcgcgccgctggccagcgcgatggcggccggggtgcgcgccgaataggccagcgcctccacttgcagcgggttgcgctggcgaaagccgtggtacaccgcggtgaaggtgtgcatttcttcgacgaagcgcagcagcagctcgctggcggtgtcgaactcgatgcgcaggctttcgtcgtgcggctgcgccagcagctgctcgcgcgccgcggccagatcctggcgcagccccgggcggacggcatccagccgcgccagcgtcggcccggcctccagcgcggtgcgcgccgggccgtcgtcattgctcagcgccgccgccgcccgctggaacagcgggtagaacagactgggcagcggcgacgccggatcgcggcgcagccgctccatctgccggtgcaatgtatgaaaggtggtcagcgccgccatgaaggtggcgttgaaggcgtgcagctggttgctgcgcgcgcgcacgttgccggcctcgaagaacgcggcggcgcggcccgcctccagcgcggcgatgtcggaagcgaagcgcagctgggtggcctccagcgtcgccgcgtccagcctttgcgtcagcgcctcctggcacagcagcacgaagccgtggtagcggccgcgcacggtgcgcaccaccaggtcggcctgatggcgcgggaagatgaaatcgttgatcaccgcgcagcagaagatgcccagcgagatttccgacacccgcgtcaccgccaggttgaacaccgccagcggatggttcagcgccggcagcgcgatcatgcaggcggtgtagcccgacagcacgaaagcgtaggagcgcgagtcgcggtacagcgtggccccgccggtgcagacgcctacccacagcgccaggctgatcagcaacagcgccgcctggccgtcgaacaggccgacgaagcccagcgccgcggcgctgcccaccagcgtgcccagaatccggtaggcgcttttctccagcaccgcgccgctgcgcgggaaggtgacgatgaacaccgtggtcatcgccgagctcggcgaatcgaagccgaggcggaaggcgatccacagcgaggcgaaagccgccagcagcgtcttggcgacgaagctccagttttcgccctcgctggccagccagtcgcggccgacgcgcctgccggccgccagcaggccggcgctcattgcggcttgccctcggccggcggctggctcaccgccacgccgccgcccagcgcgctcatcagcgcggcgaagctgtccagccgctcgctgcgtatccgcgccagctgctgcttcgccgccagcagcgccaggcgcgcggcgatcacattgtcctggtcggacaggccggcgcggtagccttgctgcgccagccggaacgccttctgcgccgaggccagcgccagttcggtctgtttctgctgcccggcttgcgactccaccttggcgatggcgccggccacctcgttcagcgcgcgcaccacgctggcgttatagctgtccaccgccgcatcgtaggcggcggtttgagccgacaacgcgctgcgcagccggccgccctcgaagatgggcaggctgatcgccgggccgatgccgcgcaccgcggtggaggccgacgggaaattgtcgaagcctatcgcctggaagccggcgaaggccatcagattgatgttcgggtagaaagccgccttggccgcgtctatcttgcgggcctccgcctccactttccagcgctgggcggacacgtcgggccggcggcccaccagttcggccggcagcgcgctgggcagccgcggcgcggcgtcgtccagcttcagcgtcggccgccgcagcgcctcgccggcggccggcccctggccgcacagcgcggccaactggttgcgcagcagctcgatggcttcgtccacttgctcgatctggttgcgcgcggccggcagccgcgactccagcaacaccacttcggcttcggcggccaggccggcggccttgcgcttcttcgccagctgccagctgcgttcgcgctgcgccagattgtcctgcagcaggtctttctcggcgtactgcagcgccagctgcacataggcgcgcaccaccgcggcgctgaggttcaggcgcgccagctgcgcttcggccgccagcacctgcgcctcgtccagcgccgcggacaacgcggcgcgctgccggccccataagtcgaggtcgtagctggcgttgagggcggcgtggttgtaccaggaatagttgccggcttcgggcggcgggatgaagtcctgctcggaatagcgctggcgggtgaacgaggcctcgccggccgcttgcggccgggtggcggattcggccacgccggccagcgcctgggcctggcgcagccgcgccgcggcggcgcgcaggccgggattgccggccagggcggccgtcaccagctggtccagctgcgcgtcgtgcagctgatgccaccagtcggcctgcggccagcccgccttggccgccgcctcctgtatccgcttgccggcgctgaggctatcggcgtccagcagccgcgactgcggcccgccggcgcccggatcggcgcaacccgccgccagcaaggccaaacccgcaatccataccgtgtagaaccgctgcatctatcgcaccaatggccaaacgcaaaatgaaaggccgccggcgatatgccggcggccccgattccagcggcagtcggcgccagccgacggcggcctgctagcttgtactatctccggccattttagcacctgcgcatgacaacagcgtcaaactgttagacattttctaatcgaaacgcagcgtatagcgcgactcggccgacatcgcggtgccggcgcgcagcaccaccgaccagcccttggacagctggtaagcgagcttcaccgcctggtcggcgctgctgatgccgtattcatagcccaggtacagctcgcgcgtcagctggcggcctaccgtcaccacctgctcggccgggctcaccgtgccgttggacagcgtcttttccttgcggctggaaacgcccagatcgtcgaacaggccgatgtggtcgttgatcgaaccggccagcatcatgccggccgaggccgccaggtcgttgttatcgcggtcgccgctggcggcgcggcccaacaccagccaggccagcttgtccttgtccgccatcgggtcgtcggtgatcagccgcaccttgggtgccgccaccgaaccggtcacctccaccccagcccccaccggcgacagccggcgcttggcctgcacattgagcagcggattgtccagcgggccattgaaggtgatggcgccgaaggtgatgtccaggtcctggccgtaagccttgtagcggcccttgtccaccttgacctggcccctggccgccggtgcctcgcccggattggcgctgacgtgcaccaggcccgacagctccacgtccagcccctggccggagaagcggaagcgctcgcccagatccagatccagcgccaccgtcagcggcatggtggcgaaggccgaaggctcggccgccggccgccccaccaccaccacgtcggcgcccaggtcgggcgcgcccagcttgggcaggcccacccggccctggtcggcgcggatgcggccgctcaacgacagccggccgccgacgaaggccagctcgctctggccggataccaccagccggcggttggggcggtcgaacacgctgaacttctgcagcgacaccttgacccgcgcatccggctgggcgtcgctgaaatcaagcgagccgctggcgttgacttcgcccttgccgctgacgaagcgcagctgctgcagcgtcagctggcggccgtccacccgcgccagcaggctgccgtcggataacgacaccccggtgcggcggtcggccagcttcagcttgtcgccgcggatctgcccctgcgcctgcggcatctgcagcgggccgcccagatcgagattggccgccagctgtccgcccagctccagccccgggccggacagctcggccagcgccgccagcgacggcaggctggcgcgtagattgccggacagcggcgtgtggccgtcgatgcggccgccgttccacggcaggctgccctggccctgcgcctgggcgaagcggctgtccacgctgacattgaaggccagctgcctgccgtccaggtccagttccgcccgcgccgtcttcaggcccagcgcgacatgccggcccttgtccagcggcagctgcacgtcgccgccgctgcgccacagcgccagcttgccgatgccggcagggctgaggctccaatcggcgtcgaattgcaggttctgctccagcggcagcttcagccatggccccaattcgctcaggcgcaggccgcgcgcgctgccgccgccgctgagcgcgccgttcgcctggcgcgtcaattccgccagattcaggctgccgcccagcaaggccagccgcgccgcgcccagtcgcgcctggccgtctgcgcccagtgtcagatctgccggcgcctgcaggctgaggccgggcttgccggccagctccaatttttgcaggctgccctgccagcggttgtccaggctcaagccgcccgccgccgccagctgcagcgcgtaattctgttgctccagctggaaacggccatccaattgcaggctgtggcgggcgcgggtgcccgacgcgcgcgcgcgcagctgctcggcgctgacgccgccggcctgcagcgccgccacgtccaggctcagctggaaggggctggcctggtcggccttgatgttgccggcgaactgcatcgactgcagcgccacgccgcccggcaggcgcagccgctgcgcctgcagcttggcgctcagcaccggtatcttcggcacgccggccagctcgccctggccttgcacgacgccggcgaagccggggcccagcaaggacagattgggcgcgttgaccgccagcttgagcttgtcgcccagcacgccgtagctgccgctggcctgcaggcggttgtccgccagcttcagatccagcaacagctgtttcagccgcgcctcgcccagcaatacgctggcgttgccggacagcggcgcgcccgacagccggctgggcgccagttgcagcttggcgcccacttccatcggctcggccagctggccggccatcttcagcgtggcgttgagatcgccgctgggcaggccgtcgcgcagccgcgctgggtcggcgtgcaccagcttgccgttcaattcgaatagccgcttgccggacaggcccagcttgccgttgacgctggccgcgccgctgcccgcgcccaattccagttttttcagcagcaaggccggctgctggccgcccgacagctcggccagcgcgctcgcctgcagccatttgcctttcagctgcgcggcgaagcgcggcgcggcgaacgcgccctcggcggtcagccggccgctgatcacgtcgtccggcgccgacgcgtgcagctgacgcagcgacagctggctcaggtccagcgccagcttcatccggtcgggcttgacctcgcccaccaggcccagcttgccgccgcccagctcggcgtggctgttgaacagctccagcgcctgctcgtcggcgcggaattcgccggccagcagcgacagcggcagccgttgcgccgacagcgcgcccggctcggtgttgaccagcgtcaggccgcctttcacccgctggccggcgtcgggctcggcgaacaccgcgaagctgagccgcgccttcggccaatcgggcaggatggcttgcggattgatgttgccgacgcgggcatccagccggaccagccggttgaacggattggcgtcgaacggccgcagcgcgccggcgatgtcgacgctgacgcccttgccgtccatttcgccggagaaggccggcttgagcaggtcgccggacaggtcgagcctggccttcaccggcacctgctccagctcgcccttggcggacaactggccggacagcgcaaacggcgaggccgccgacagcgtcaggccggcgcgggcctcgccccagggcgaatccagccgctgcaattgcaggcggtggcgcgcgccgtcgtaatcgtaggcggcctgcagccggtacaggctgaaatgcgccggctccagcgtcaggctggccaggttcagctggtccaccttcagccgcagcggcaaggccagcgtgcgcggcgcggccagcggcgcgcttttctgttcgggcgcgggccggctcaacacccgcacatggccgacgtccagccggctgatgcgcagctcgccgcgcgacagcgccgccggctgccagtccagccgcagcgattcgatgtcgacatcgtcggcgccgccgcgcaggcggatgtcgcgcagcgcgaagccgcgccacagcgtgccctgggtcgcgcccacgctcagccgctggccgctgagccagtccagtttgcccagcgcccaggcgaagccggccgggctggcgctgatccagcccaggccggccagcaacagcgccagcgtcaaggccaggcaggaaaacgccagccgccagcggcgcgggcgcggcggcgcggcgggcggcgcctgcggcgtttcggggggaagatcgtgatgttcgctcatgcttgcggcggtttagaaagccaggcccaggctgaggttccagcgtatcttgccgtccccctccgccttggcgatatcaaaagacagcggcgccaccgggctcatccagcgcacgccgacgccgttggcgcgcatggtctggaagcctttccagctgtcggcggcgttgccggcgtcgctgaacagcgccagataccagtccggcttcaccggaatctggtattcgacgctgccggtggccaccaccctgccgcccagcaccgagccgttggggccgggcaggcccaggctctggtagtcgtagccgcgcacgctgttggcgccgccggcgcggaacagcagcgccgaaggcacttgcgcgccctccttggcccagacctggcccagctccagccgggcgacgaaggtgccgtacttggggaagggcgaccagtaaccgaccgcgcggccataggcgcgcaccatggatgtggacgacgccagcgcgcccagcgagccggacagctgaccgtccagcagatagccgctgcgcggccgcatcaggtcgtccaccgcgcgctgggtccagccgtacaccagctgggtgacgtgggtgtcgctcgacgtgacgccgccggcctcggcgctttccttgaggaattccacccccagccgcgcctcgatattgccgcggctgcgcaggcgccaggcaccggcgtccatggtattggtcttcaccccctgcacgttttccgacttgaaggcgctggtcagcgagtgcgaatagccgtcggactcgcgcgggaagcccaggccgaagctcagcgactgctgctcgcgcttccagtccaccagcgccgagccggtccagccctgctggaacagattgtagtggtcgtaacccacccgcacgccggggccgacgtcggaatcgtaagtaaggcccagctccagctttttcttcggcagctccaccacgtccaccgtcaccggcacctggttgtcgacgatgtggtcgaaatcggcgctgacgatcaccgaggagaactgcggcgactgctccagcgccgactggaaggccagcaccttgtcctggtggtagggcgagccggggttgaaatcggccatgccggtggccagtttttccgggtagcgctttaggccgttgaccttgatcgcgccgaagcggatcagcgggccgctgtccaccgccacgtcgagcgtggcgcggcgggtggccgggtctatcctggcttcgctcttgacgatgcgcgccttgggaaagcggtcggcctgcacccggcgcagcaccgcgcgcttgccggcgtcccagtcggcctggcggtagggcgcgcccatcggcagcgtccaggcttccagcacctgggcgaaacgctgctggtagtcgctttcctggcggaccgcgccgtccagccggatcaccacgtcgtcgatcagcaccggctcgcctggggaaaccttcaccttcacccgattgccgccttccagcgccgcctccaccttggcgccgaaatagccctcggtttccagcagttttttggcgtcgtccggcgtgctcttcaccagcgcctccagccagctctggtcgatgtccggatcgcgctggttttccaccagctccaggttgtcgcgcagcaattgcgccagattggacggcgcgtctatctccaccatgtagtcgagcgcggcctgggcctggccggccagcaaaatggccgccaacgccaacagccgccggcctggtatacggcggcggcgatgcgagcgagcgaaaacgagggaagcgcttggcatggtccggttcattggggaatgctgcatggtaacggaagtcggccggactggcgacggcaaacgattgtcgaacaaggggtgtcagacaagcgcgcgcgccaggtagttcaatggcggacaatatgatggaaaactggaaaaccgggcctgcccgcgccgttagcggtcggtgacgctgaccgatccaaccagcgcgaacaaggcctggacatcatcggcgtccggctggaacgcgggggcatgaaaatcgccagccttgccatcgcgccggaacagcagatggacgttgcgcgcctgcgcgggctctccgtcccgctcggcgcggaccaggcaggagacttgcacgcccgccggcagcgcattggcgcggacgctggacgccgccaccagaggcgatgaccgcagcttgcgcaggaagcagcggcagatcggctcgttggactccgcccctcgcaagaaggcggctcgacaaacagtgaaacgttcaacttgcccgctgcggccgcgtaaacaaagcggtctggctgcgcaacggcttccattccggcgcgtcgaaacgcacctgccagccggcatcgggcgccgcgatggcgatcggctgggccgtggccgcaaacggcgataaaagacaagcaagccaaatcaacgatttcatttcgtttccatcatgcatgtcaatccgtgggcggcgcgccattcaccggccttcgcggcagtctcccagataagcccgcagcaggcggaccagctcccgccgcacgccggcctccgccagcctgccgcgcctggccgcattgtggaccacgccttcgatggcggaggatatcgtctgcgccgccagctcgtcatcctcgtcccgcgccacgccgcggcaaccggcgacgatcgcgcggtagcgccgcaggtattccgcctggaaagcgtcgccggcggcgcgcatctcgtccggcaccggcacgtccagcaacgcccggtgcagggccgggcagccgccgtggacggcgatcatgccgtccaccaggcgctccagcggacactccggccgccccaggccatcgcagacccgctgcaaagcggccagcacctcgtcgaaatggcggcggcggatggcgtcgaccagcacgatcttgttcgggaaatactgatacagcgaaccgatgctgaccccggccacgccagcgacctcgctggtggtgaacccgccccagccgcgcgcgcccagaacgcgagccccggcctcgacaatgacgtccaccgtggcccgggaacgggcctggcgcggggctttgcgcatcgccagccgcggcccggaaatgcgaatggacatgccggcctcctccgcgaacaatatcaatgatgcggcatcctattactcacatggaaaggttagcatcatgagcgcaagcagactattggcgcggctgttccgctaccaggcgtgggcgaacgatgacatgctgcgggcgctggcggcactggaccccggccggcacgccgaggaacgccagctcggcctgcggctgatgaaccactgcctggtggtgaaccagatcttcgccgcccatctcgccggccgcagccacggcttcgccgccgacaacacgcccgataccccggccccagaagcgctgcggcgcgagctggcagccgtcgaccgctggtatctggactacgccgaagccgccaccccggatctgctggcccagccgctgccgttcaccttcaccgacggcgatccgggcttcatgagccacgaggacatcctcgcccacgtggtcacccacaacggttatcaccgcggcgaggccggacggctgctgcgccaggcgaacgaccgcgccccgctgcgcggcgagctgccgtgggacacctacgccgttcacctgcaccgcgccgagccggaacgccggcggcaaggccgcgccgcgccgtaactttccgctcaatcatgccgtggccattgccgtttggaatagccgcggccaatggtttaccgatagcgggacatttccgcgcgccggcccgcggccgcggcaaaaccatctatcgtgaatcaggcaggccccggcccgccgcgccttgcggccgggccggcatcgcctcgcccgcaaagcttgtgaatgtccgtagccacccggcgaggccgccatgttcgacaaaagcgacaaaagcatcattctgaaaaccatcatggtggccgcccccatcctgatctgcatgggcctgctgccggtgctgtcgttttacatcgaaaaactggaggaaaacggccgcgccgaaatcgtcgactacatcgccatcgcccaggcggcgatggaggtgaaattcgacgccgccgacctcaacggctggcaaaccggctacgccttcgacatcatccgccatgtcgacggcgccagccgcaacgatgccgtgtcccgcgccgaattcctgcgctcggccggcaatttccgccgcgacatccaggcgctgcgcgcgatgccgctggccgccgaccagcgcaacctgctggacgaggtgcagcaggatttcgacagcttcatggcgctggatgcccgcatcatcgccatgtaccgcggcggcgcgcccgccacccgcgacaaggcgtccaacctggtgatgggcgaggaaatccagatcttcaaccacatctcgcagaacaccaacgcgctggcggtatccatcacgctggacctgatgaagaaagtggcgcaatccaactcctacggcatcgtcgcccgctggatgatgctggtgatgtggatcatcgccagcgcgatgggcattctgctggtgcggctgctgcacaagtggctgggccaaatgcgcagcctgatgcaaaagctggaatcgctggccggcaccgacgaactgacccagctgcccaaccgccgcacctgggacatccagatcgaaatgatgctggccgccgccaagcgctaccgccagcccatcgcggtggcgctgttcgatctggaccacttcaagcagttcaacgacagccacggccacccggaaggcgaccgcctgctgcgggaagtgtccatcctgatcaagtcgcggatgcggcaatcggacctgttcgcccgcttcggcggcgaggagttcgtgctggcgctgatggactgcgacctgccgcaggcggtgacccgcatcgactcgctgcgccgcaacctgccggacaaccagaccttctcggtgggcgtcacgctgtgggcggagggcgagcgcatccacaataccctggcgcgggcggacaaggcgctgtaccaggccaaggacggcggccgcgaccgggtggtgggggtggagccgcccgggggcagaatcgaagggcgctaggcggccagctaaaccagcccttcggccaattgccccagcgcaaagatgccgcgcgccggccgcggcctctccgccggccaagcgtgaaagccgctcagccacaccggcgccatccccgcccctgcggcgccgatcacgtcattgagcggatggtcgccgacataccagcactccgccggcgccacccccagcgcctcggccgccagccggaaaatcgccgcgtccggcttgcctacccctgccgattcggagctgaccgtcagctcgatggccgatgcgaacggcagccgcgccactttctccagccgggtgcgatggctgccattggaaatcaccccgatgcggacgccccgcgccagaagagcggcaaccgcctccgccgcgcccggcatcgccgcggtgcaaaccgcgttgtagcgctcccaatgatccagcagcgcctcctgctccaccgcttgccgccagacgatctgcgttttcaagccatgggaaaccgcctgcttgatcgaaccatgcggcgagccggcgggcaaatagccgccgttgtcgcaacgcttgatcacctctgccacccgctctgccccgccggaaccgatggcgtggccgaaatcgcgccagaactgaagggcgtaaagatcgatgctgtcgttccggtgcaccagggtgttgtccagatcgaagaaaacggcttggggcagcgtcatgccacatcctccgcgctcgccaggccgccgtactccgccgaatacacatagcggccatcccgcgcgccggacacaaaatcggcgaagtacgcctcgaattgcccccacaactcatccatgttcaacctttcctttcgctatgcggaaattgttccgcgccaaagaagacggggcagccatcagcctgccccgcgtcatccaacccgctttgcgctcagccggcaatccgccccatccgctccgccagccgcaaatggcaggcggaagccagtttgaccaagtcggtattgttcaccggcatcctgcccggttcggcgatcaactccgccaagccttccagcgtggcgacggagctggtcaagccgatcagcttgccatgcggccagcgctgcttgttgtggcgctcgtaatccagggccaccacccagcgcgaatgctgccacggcctggggccgcgcagcaccgcctccatcaccgcccgccccacttgctgcgccgcctcggcggccaaggccagcgccagatgcagactctccgccgtggtggccggcccgccctcatgcagcaaggccggccgggtttcctcctgccaccagcgtcgcaaccgccgcgcgcccggtttcttgatcctcctgaccacctcgtccagctcgccttcggacaagcacagcaccggctcgtcctcgcctgccagcaacagcaagcggccggcgggttgttccagcgtgtgtagcaggtcttccacctcctgtttcatcgaggcggcgatttcggcggcgacgaaccagaaaccctcctcgcggcggaggacgcgcagcgggaaatttttggcgtagtcgaggcggagggggaggtttacggagaggtcgaggtggtggttcatggctgggcctccacaagctgattggctactcgggagctagcgggaagagacaaggagtaactgaggacaagcagcgcctcagcaatacgattgatcatggccatgatggcctccttatgctttgagatgagaagtccaccgtatcggggtgggggcgctctcaacggcataagtcgtccgggtccttgcggatacccgacaccccccttgatctcttgcgacgtgcgaacgcacgcctagaaagaaggcgtaatgataccgccagaactgggcgggtgcagcttatgctttgagagaacctccaagctaatccgccttcagctttatgtcaatgcgctaagtattgctgcgtaatcaatagctttttgctgtgttgtactgctctttgtgcgtgatttggtatgtaattttattaggttggtactctgtcaacggggtagataaagggccatgcgaaactttatcgttgtaagagttcatgctttttatgcataggctaatgacggttgtttgctatagttgcaagtactattttgaacggattatattgtaaatatttttaaatggttagatatgggaaatgttcataaatgcttttatttcgatcattttttgctctttgagcccatcagagatgggctcaccttcaacttattgccgagcaaatcttttgtatatattcggaagctcattttgggctaacttccgaacactagcaccttctctaatatacagttcatcattatatagagaagggtcttcttgagcagttacttcaaagataatgagggacttttctttgtaatttatacattttatatttctgcaaatatgatcttttaatgtcttatcaagaggtgactgtctgattttttcaactatattttggtaatattgatcaattgttttattggtctttgtagcttcatgatcaataccacttatataaaatccattttgctcatatgattcaattccatgaattgatcttattcttttagttgtttcttcagaatcagatattcctactattacatatccttttgcattgatatcaaggttagcaatcccagcacaagtttttaatattttttctaaagatttgacatcaaatttgtaaggagattctagttctaggaatccttgtttgaaatcgtaagatgcttgttctgttttgctttgtgtaagtaagttatttagcttactttcccagtgtgattctataggatcgctttcttcattgtgaataaattcttttatgattaacttttttaatctttctacttgatcttttctgtgttctgccccccatctcccaccttcttgtggctgtattttagggccatgtttttttaatttctctatgagcccatctattgatttaactcgcatgttgttatttattattatttcgtatagtgcaagaaatacgatttgaaaaactctgggtgctttaggttgtgcatcttgtccgaaaagtatagttgtcaatgcaagtccagatttttttgatgcctcaattattgtgtcaattatttttaaaaaattatcatttaaattttcgatccctatctttctggttaaaaggttaacttcattgaatctttttatagatgcttctgtgtcacgtaaaccaaagtagtcgtcaagatactcacttcttgatcccggtttttcgtggctaatgacgtatgctaatatatcagcaataatttgctcatcaaggctttgtcgaacttcctctttggaaagaactccttgtgatacccaaaaaacagaatccacatcaatgccataccctaagtctctacttgcgacactaattaacttcatcttatttaaaggtaagatgtcggagtgagaagaatctcctctaatacttgcagatatctttctggttgctgttgagaaatcatcaagtgagccggcggctcttaattcttgtcttgagagcttcctaccaccagagttaattctcctaaatacttcatctacatcagtatctgaactgtattcaaaaattgacatcggaacttcataagcagttattttgacgcattctgccctgtctaatttaggaaggttttgtttcaaaaccccagcgtctaacaattgctttgttgatgctattgattcaaggtcgaaatatctattatcaagtgtaatttcaccttcaataaatgaaaaaatagcatttagtcgctgcattccatcgattatttctatcgattgggattttatattctcggctagaagtatgattggaactggaaattttttagaaattgaatcaatgaaagcttttttttcttctattccccatactaattttctttgatatctacgattgactgtgtatttgtcttctacataattaatatatagtctttcaattgtttcacctttgaccgtaaggtcttgctttactttgtttatagatttcatgatataggctcacatccgcttgacaaagagtcaatataacacaccagttgacactggcatgcctgagtgattgaaaatcagtcgcatggtatgtgaattgtcaaatgaaaaatatttaaacaataattaatatcactacattttatattattatgtataatttaaatacagattattagtgtaaaattggttaatacacatataggatgatgtaaagccaattagatttatttggtatggcctatgatgtaccgttggagtacgaactactgggcccaatgtccccatcagcgcaagccggcttcgaagccattcccaaggtggctgttcgacgcggggcgacgttaacccggtaagttgggctccatcgtaggttggcgctgagcgcagcgaagcccaacgttcaccgaggcctactcctgcaactgcaccacaacaccttcccctgcccaatccgcaggcaaccaccccaacctgacatagcgatggaagctggaatacggccaatccgccacccgctccgcatcgccatgcttgaccgggttgtaatggatgtaatccacatgcgcctgcaaatccgcctcatcccggatctgatgctcccaataccgccgctgccagatgccgcgctcccgcttgcgctctcgactctcccggatgcgttcgactttgggcagactgcgcgaaaacgccgccttgatcagcgccattcttgtcgcgtaatccgcgtcgccctgcggcaaggcccataccgcatggaaatgatccggcaacaccaccatggcgacgatctcaaatggatggcggtctcgcacttggcgaacaacctgccgcaaaacgtcgatatggcgcgtcagataatcttgtcgccgatccgccaangccacacagctggccaaactggcgcgcaacgatgcgctgaccggcctgaacaaccgcatggccgccaacgagcagctgcaggacgagcaccagcgctatggccgcagcggcgaaccctatgccgtgctgctgctggacatcgaccatttcaagcgcgtcaacgatagctgcggccacgacgccggcgaccgcgtgctggcccatctcgcccaagtcatccgccaggcggcccgcgccaccgatttcgtcgcgcgctacggcggcgaggaatttctgctgctgctgccggccaccgatgccgaaggcgcggcggtgttggcggagaagatccgcgccgtggtcgagcaatcgcaagcgccggatgtcggccgcatcaccgtcagcatcggtctggcggtggccggccgtgccgatgaacagccggaagcggtggtgaagcgcgccgaccaggcgctgtaccaggccaaggccggcggccgcaaccgggtggagggtggcgcctaggatgcgttgccgtgtcggcagtggtctgttgtgagtcatgcgttaggaagctgagggccgagagctacttgataggctgtcatgtgtgtagatgggatatggaacgcagtgggatgtaatggtctgtcccactccccatggacagcgggttaagcactaagctctgaacggcggcgttcgaattcaaccggggtcagataccccagggttgaatgacgtcgttggtgattgtaaaagcggatgtaatcaaacacatccgtacgcgcctcctcgtagctccggtagtgggtcagataaacacgttccgacttcaatgaacggaagaagctctccattgctgcattatcccagcagttcccggtgcgggagtggctcggtaccattccgtgccgtttcagcaatgcctggtagtcaaaggcacagtactgactcccgcggtccgaatgcagaatcacctctcctgaaggctggcggcgcgccactgccatcgtcagggcagcatgcaccagttcttgcggcattcgatgatgcatggcccagcccactatcgcccgggagtacaagtcgagcaccaccgccaagtacagccacccttcaccggtccggatataggtcatatccgacacccaacgctgattgatgtcgccaccagcagcaaattgtcgctgcagcagattaggcgccacgggtagaaggtgttgaccaccactgacgggtcgacaatgtttacgcgttctaaccctgataccgtttcgccgcatcaggcccgcgatgcgatgccgcccgcaggcgaagccctgtgcaagaagttcggcatgaatacgccgatggccataaataccattgacctcggcatgcaccagccggatttcacgtagtagttgtcggttcgccatctctcgcgccgaaggtgggcggtgtagccacgcatagtagccactgcgggacacacgaaacagttggcacatcggggctaccgggtagcggtccgacagcgcctgaatcgcgcggaatttcacttcgtgggttgcgagaagatggcgagcgccttttttaggacatcgcgctccatggtaacgcgggccagttcatcccgcagtcgcttgagctcggcggcttcaccggtctgtttgcctcggccagggaaggcatcgggtcctgcgtcttggagttgacgcttccacttgcccagcagcgactcggtaatgtcaaaggcttgggcaacatgccgtaacggggtgccggcaagcacctgctcaaccgcttcgcgcttgagggcctccgggaaagtacgtctggtcttggtcatgaacactgctccttggtggggattatccaccttaagttagtgtccacggggaatgggacagaccagttagtcgggcgtacagggcccgctcagcgcttatttttggggcctgaagcttttgctatcaggcgctgggcgaaggtgcggcttgtccgtcactagtgactgtgtgcaatcgtcaccagtcgatgaggaagggaagcctttgcaaatcaaaaatgtcactacgtcaccatcgtcaccatgcgatttctgcggggaggctgctgcggtcttgagggcgttgctctcaaggctccagggcctacatctggttgttggcattcatgcatttttccaaccagagtatggattgcaaaaggtgctagggacgttgtgtatagattttatcgatggtttggcgcatgtgcacaaatctatacacaaaaaatgtagatgttactggatggtcttggatggctctggacgtaaaaaaacccgcaaagccttatttggcgcgggtttgtggactttcttggactgctttggaagtgtgggtggtgcccccgacaggaatcgaacctgtaactgccccttaggagggggccgttatatccatttaactacggagacacgacggaaaactgtggtcaggcgctgcggtccaccgacaggcgggccagctcggtcagagcttggcgggtttccgtatcggggatggcttgcaaggcggcgatggccttttcggccattttggtggcttcgttcttggcgtagtccagcgcgccgcaggattgtaccgcagcgagcacatcctggaaaccgtcgcggctggcattttccagcgccgcgcgcacggtggaggaggcttccgggctgccgtggcgcatggtgtagatcagcggcagcgtgggtttgccttcggccaggtcgtcgcccaggctcttgcctatggtttcggcgtcgccgctgtagtccagcacgtcgtcgatgatctggaaggcggtgcccaggtacatgccgtagtcggccatcgcctgcacctgttccggcgcggcgtcggcgatcagcgcgccgacgcgggcggcggcttcgaacagcttggcggtcttgtactggatgaccttcaggtattcgtcttcgctgacgtcggtgttgccgatgttcaacagctgcagcacctcgccttcggcgatgatgttggtggcttcggccatcacttccagaatggtcatgttgcgggtggtgaccatcatctggaacgcgcgggtatagaggaagtcgcccaccagcacgctggcggcgttgccgaacagcgcattggcggtcttgcggccgcggcgcaggtcggattcgtccaccacgtcgtcgtgcagcagggtggcggtgtggatgaactctatcatcgccgccagctcgaacaggtgttccccctggtagcccagcgcgcggccggacagcagggtcagcgccgggcgcaagcgtttgccgccggcggagatgatgtattccgccacctggcggatcaggaccacgtcggagtgcaggcgggcgcgtatgacgcggtctaccgtctgcatgtcgtcggctatcagggtacggaaaagcggggtggacacgttttcaaccagtatcgttgcgatggctacgccaaagtgcagaatcttaccagaaaaggcccgccgctcgccatgccaccgtagtggggccttaagttgatgaaatcattgacaacttgacttcaggcacgtatattctcgcgttccctgcgcaacaggcgtggggattttcaaatcaggagctcatgcgaatgtatgcggtcataaaaaccggcggcaagcagtacaaggttgtcgttggtgaaaaactcaaagtagaacagatacctgcagacgtcgacagccagatcgtacttgaagaagtgctgatgattgctgacggtgaacaggttgttgtaggcgccccgatgattgccggcgccactgttaaggccaccgttgtttcccacggtcgtggcgacaagatccgcatcttcaagatgcgtcgtcgtaagcactaccagaaacaccagggtcatcgtcaaaacttcaccgaaatccgcatcgacgcgatttcgaagtaaggataaacagtcatggcacacaaaaaagcaggcggtagctcccgcaacggtcgtgactccgaagccaaacgcctgggcgttaaggtttacggcagcgaactgattccggctggttccatcatcgtgcgtcagcgcggcacccgcttccacgctggtgaaaacgttggccagggcaaggatcacaccctgttcgccaaggttgatggctacgttgaattcaccgttaagggcgcgcaacagcgcaagaccgttaacgtgattccgtacaccggtgttgacggcgaataattcgctttccagcatccgagaaagccctatcctacgatagggcttttttcataccgaggggcaaggcgtgagggctggcgccagtcctgacccctgactcctcgcagatacagaggttgtagacatgaagttcatcgatgaagcccggattgaagtgatggccggccgcggcggcaatggcgtggccagtttccgccgcgagaaatacattccgttcggcggcccggatggcggcgacggcggcaagggcggcagcgtgttcgcggtggccgacgagaacgtcaacaccctggtggagttccgcttcgtcaagaaatacctggccgagcacggcgagcgtggccgcggcgccgactgctacggcaagggcggcgacgacatcgagctgaaaatgccggtgggcacggtgattaccgaccacgacaccggcgaactggtggccgacctcacccaccacggccagcgcatcatgatcgccaagggcggcaagggcggcctcggcaacatccatttcaagtcgtcgaccaaccgttcgccgcgccaatgcacgccgggcgagcagggcgagcagcgcacgttgaagctggagctgaaggtgctggccgatgtcggcctgttgggcatgcccaacgccggcaaatccaccttcatccgctcggtttccgccgcgcgccccaaggtggccgattacccgttcaccacgctgcacccgaatctgggcgtggtgcggatggacgacagccgcagcttcgtgatcgccgacattccgggcctgatcgaaggcgcggccgaaggcgccggcctcggccaccgcttcctgaagcacctgcagcgcaccggtttgctgctgcacgtggtggacatcgccccgttcgatccggatgtcgacccggtgcgcgaggcgcgcgccatcgtcgaagagctgaagaagtacgacgaagagctgcatgagaagccgcgctggctggtgctgaacaaggtggacatgttgccgccggacgagcgcgaactgacggtgtcggccttcctcaacgcctacggctggccggcggacaagccggacgacagcgatggcttcgacatcaaggcgccgcgcgtgttctccatctccgcgctgaaccacgaaggcacccgcgagctgaccttcgccatcatggcttacctcgacgtggtgcgcgccgccgcccgcaagcaggcggagaaggagcgcgaagccgccgccgccgcgcgccagaccgtgatcgcgccggaagcgccgtcatcggcaacagaaggcgaccaagcgtaacggcaggttcatgtttatgtgataggcaaacgggtcagaggcatatctgacccgtttttttattcacattgggcaaaatgcaggggtttgacgggtttttgccaatttttgtcgctttgctgtacaccgatctcttcacgtgtcgttacttctcaagtcgattggatgttgtattttgtcctcagacaaacaccacggcggcagccggttttccatagagatggcatgaattctgctaagtgaagcgccatatgcttcatcgatgaagatggcattttcagaaaatcgggcttgctagacaaattgctctaactatataacatggtgcagccatccccgcggcagcggagctggccgcccacgtggcatcgattgcagtttgctgtcccggtccgggcgcggtttgcctgggagacaaagtccggcacaagccggacagaccaacaaagaagtttgctttgatgaggagaatcacatgaagaaggcacttgctgcgctggccgtaggtttggtggccgcatcgatgggggcttacgccaaggactggaaggaagtgcgtttcggcgtggacgccagctacgcgccgttcgaatccaaggccgccaacggccagatcgtcggtttcgacatcgacctgggcaccgaaatctgtaagcgcatgaaagccaagtgcgtatgggtggagaacgacttcgacggcatgatcccggcgctgaaggccaagaagttcgacggcgtgctgtcgtcgatgtcgatgaccgaagcccggatgaaggaaatcgccttctccgccaaactgttcaacaccccgacccgcatgatcgccaagaccggcgccggcctgatgccgaccccggcatcgctgaagggcaagcgcgtgggcgtggagcagggcaccatccaggaagcctacgccaagaaacactgggcgccggccggcgtggaagtggttccctaccagaaccagaccctggtgctggccgacctgaccgcgggccgtctggacgcgtccttgcaggatgcggtgcaagccgacatgggcttcctgaaaaagcctgaaggcaagggcttcgccttcgccggcaaggatctggtcgatccgcaaaccctgggcgaaggcgccggcatcggcctgcgcaaggaagacaccgacctgaaggccgccatcgacaaggccatcgccggcatgctgaaagacggcacctacaagaagatcgagaagaaatacttctccttcgacgtatacggcaactaagtgctgacggacgggcggcgcgccgcccgtctgctgttgcgatgcgccccggtccgccggggcgtattaatctggaggacccgccgccatccggcaagataagccgcaggcgcgggccactcgaagggggaacatcatgtttctggacggattcggtcccattatctggcaggggaccctggtgacgctggagctgtcggtgctgtcgctgctgctggccttcgtcatcggcctggcgggcgcaggcgcaaaattgtccagcaatcccgtactgggcgggctatccaccatctacaccactttggtgcgcggcgtgcccgacctggtgctgatgctgctgatcttctacagcctgcagatcggcatgaacaagctgaccgatgcgctgcatatcgatcaaatcgacctggacccgttcgtgtccggcattgtcacgctgggcttcatctacggcgcctatttcaccgagacgctgcgcggggccttcctgtcggtgcccaagggccagatcgaggccggcatcgcctacggcatgagccactggcaggttttcagccgcgtgcagttcccgcagatgatgcgattcgcgctgcccggcatttccaataactggcaggtgatgctgaaagccaccgcgctggtgtccatcatcggcctggccgacgtggtgaaggcgtctgtcgacgccggcaagagcacctacaaggtgttcttcttcaccctggtggccggcgccatctacctgctgttgaccacgctgtccaatttcgtgctgatgaagctggagcgccgctattcgatgggcgtgagggaggccgagctatgatagacatcatccagcaatattggcgcgcgtttctgtggagcgacggctaccacctgtccggcctggctgttaccatgtggctgttggtgctgtcgatagccttcggcttcgtggtttcggtgccgctggcggtggcgcgggtgtccaaggtgaaatggctggcccgcagcgtgtggctgtacacctatgtgttccgcggcacgccgctttacgtgcagctgctgttcttctacagcggcatgtacagcctggacgtggtgcgcgaggtaggcttcctcaaccacttcttccgcgaaggctacaactgcaccatcctggcgtttgcgctcaatacctgcgcctacaccaccgagatcttcgccggcgcgatcaaggcgacgccctacggcgagatcgaggccgggcgcgcctacggcatgagcaccttcaccttgtaccgccgggtcatcatcccgtcggcgctgcgccgcgctttgccggcctacagcaatgaagtgatcctgatgctgcacgccaccaccgtggcctttaccgccaccgtgccggacatcctgaaggtcgcgcgcgacgccaacgccgccacctacgattccttcaacgcctttggcctggccgcgctgctgtatctgagcatcacctttatcctggtcggattgttccgcaaggcggagtcgcgctggctcgcctacctgcgtccgatcaagagctgagaatgactggggaattcaagatggacaagctgaacatcagcaacattcacaagagctacggcgaccacgaagtactgaaaggcatctcgctgaaggccaaggccggcgacgtcatcagcatcatcggctcgtccggttccggcaagagcaccttcctgcgctgcatcaacttcctggaaaagccgaaccagggcagcatcgccctcaacggcgaggaaatccgcctggcgaaggacaagcgcggcgaattgatcccggccgaccagaagcagctgcagaccatgcgtaccaagctggcgatggtgttccagcacttcaatctgtggggccacatgacggtgctggaaaacgtcatcgaggcgccggtgcacgtgctgggcctgccgcgcgacgaggccgtcgcccgcgccaagaagtacctggaaaaagtgggcctggacgaacgcgcccaggccaagtatccggcccacctgtccggcggccagcagcagcgcgtggccatcgcccgcgcgctggcgatggagccggaagtgatgctgttcgacgagccgacctcggcgctggacccggagctggtgggcgaagtgctgaaggtgatgcaggcgctggccgaggaaggccgcaccatgatcgtggtgacgcacgagatgggcttcgcccgcaacgtgtccaaccacgtgatgttcctgcacaagggcctggtggaagaagaaggccatccggacgaagtgttcggcaataccaagagcgaacggctgaaagctttcctgtccggtagtctaaagtaaaaccatccctgccaaagggggtgggaaacccgccggagcggttagccggcgggtttgtttttgcctgtcgctgtggatatcttcgatatttcccgatggctgtggataagccggcgcgcgacggccttgcctcgatttcaggcccgtcggcgggccgggatcaatgcggatgcatttcgcggaaatacgtccattcttccacttcgcggccatcggccagccggcacagcgcgtattcgccgccgttggcgtctttttgcggcagcagcgtgccgccttgctgcacgcagaacaccgaggccggattggccatgccgacggcgcgcggcggcgcggacggggtttgcgcgcaggcggccaggcccagcgccaggatggcggcgatcgcgagaatcttcattgtttcatttccagttgggatcggctttgagctgatcgttgagataggccttgatcttggcgccgggtttgccgaaccagcggtagcgggcatggcgggccggatgctccaccgcgtccggcacgtcggccacggtcaccagcagcccccaggcctggcgcttgtcggcgcggaagacgccgtagaagcggttggcgctgcaatcatgcggcttgcacatctcgccggccagatagttttggccgtctatgctggcggcctggtagggcgaactggtggcgcgcgcgcggctgacccagcgcggcacctttttttcgccggccagcatggtttgccaggcggcgtggtaggcgggctgggccggcagttcggcgaacaccgcggtggcggcgtcgccggcgcgggccggcgcgggagacagcaagggcagcagcaacagcggcagcagggcggggagcgagggtttcatggcggaagtccgggcggcgcatcaaaagcggttggatggccgccgccggcaaaaattccgtcaggcggtcagcagcttgccgctcttgaacgcggtgctgccggccaccctggccaggcccaggccggcggtggcatagggccggtcgctggtggcgtacagcacgccgccgcgctgggtgcagacctggctgacagtgtcgttcagcgggtctatcacgtcggccaccaggtcgccggggctgagcaggctgccgggcgcggcgcggtacaccaccacgccggcatgcggcgccagcaagtcttccgagccggccagcggcgtggccgggtggcgcagcggcggcaacggcggcgcgtcgccggcgatcgcgccgcgatgctgcaggaaatggatgatggcttcggcgtccttggcggcgtattcatggttgacgtcgttttcgccgcgcagctctatcgtcaccgccaggcaagccatctcgatcggcgcgtcgatgcctgcctggaccgccagctcgcgcagctgccaccagggctggctgcaggcttcgtcgaagggctgatcgccggagtcttccgccagcaggctggcgcaggcgcccagatagcgcgacagcggctcgcactggtcccacagcggcgtgccggtgtagacgtgcagctcggcgcggctgtcgcaatgcaggtccagcatgatgtcggcgtcgaaagccaggctatgtagtgcgtggcgcagcgattgcagctcgctctgcggctgctggcgcgccagttcttccttcatcgccgcgcggatcaggcgggtgttggccctgggatccggccccagctggccgcgcacggcggcgaacaccggctgcgccatcgcgtggtagtggcggttgaagttctggccgctcatcatctcgaagcggcccagcaggcggttgtgctggttctggttgaggccgatcggattggcggccggcagcacggcgatttcgcccaggatggccccttcgctttccagctgcagcagccgctgcttcaggtgccaggccactagcatgccgggcagctcgtcggcgtgcaggctggcctggatgtgcactttctcgccgcggccggcctggccgaagtggaagctggtcagcgcgcgctggctgcccagactgggcgacagcagcggatggtggcgggttagcatgggatctcctcattggattgttatcggcttgcttacggcataaaacgcgccgccgcgttgactaagcggcaggcggtcgggacaatcgctgcttcgattcatccccgtccgtggagcgcgcttggattcactgtccgatttcttccagcccggcatcgagcccggctcgttgcaggcggtatcgcggctgcagggcgcctggtcctacctgtcggtgttcgtcacgctgttccgcggcggcgacgaagaggtgctgatgcgcctcctggtgctgcgcgaactgggcggccgcgccgaggcgccgttgtggacgccgcaggaaatcgcccggcgcttctcttatcttaacgataccaaactggccaccattctggggcgtttgcgcgagggcgagttgctggtctacgacagcgacggcggcgtctaccagctgtccgagggcgcgcgcgtggcgctggcggcgctggctaccctgatcgatttttccggcgacgacgtcgagctgggctatctggctagccaggtggcggccggccaggcggtgggccaggtgtccgacgaggcgctgcggcatctgctggcgcggctgaacgagctgtacgcggaattcgaggaggcgctggagtcgcagtccgaattccgcatccgcgccgcccagcaccggctggaagcggtgtggcgctgggtggccaagtccaccgaggtggtgaaggggctgacgcaggacgacacgctgagcctgaccgtgctgaaccaggcgcaggccatcgcgctggcgcaaagccggatgctggccttggccggcaccttcgagcgccggctggcgcaactggccgcgcagcgcgtgcacctcggcaattccggcctcacctccaccgacatcgccgattggctgcgccgccagggggcggccacgctggccggcaagctggccggcgcctggtccatctgtccggagccggccttcctgtccacgccggagctggccgacgtggccgagttcgagctcttggcccgcgagcgcgccaaggccggcgcgcaggtgctgcccggcagcgaagccgcgccggtggccgacgcgccggaaatggagcggctgctggaggcagaggagatgtacgacctgctgctgcagctgggcatgagcggcgcggccgacgcccacatcagccaggcggtgctggccgacagctacaacgaaacagcgtaccgcctgtccttgctgtcgctgatcggcgacccggaaaccagcaacgatcaaagcatcgtcgccgcgctggccaagctgccgttcagcctgcagggcggcgacgcggtgatagagatggatcaccccgaggtggcgactttgtcggatgccaggctggtggcggcgcaacccaagagttgaaccctttatttcgccacgaaaaccacgaaagacacgaaaagtgcaaattcagcgagatgcttagtcctctcgctgagggctgaagaagacagctttcaaatcaatctttctttggatattttcgtgtttttcgtggggttcgtggcaagagaagatatggaacacgaaatcaaaaccctcaccgcccgtttgctggcgcagcgtgtggtgccgcgagccgacgcgttggcgcgcaaggccttgctggacgacatcttccgcgccgagctggacaaaagcctggccgccgtcggcctgcgcctggtggagaacccgtacgccgagcacatcgccgcggcgctgctgccggagatgaccgagccggtgttcggctccggtgacgcctggctcaacaataatctgggcctgccgcgcgacggcgtggcgctgctggtgatcctgtgggcgctgatcatcctgcccaagcgcgagcggcagatcgcccgcgtcgaggccggcaaggagaaccagagcgacatgttcggcgcgcaaaagccgctggaaaccggcgagacggtgtccaccggcatttccgaggacgcgttgtacgccgacttcggcaaggcgctgggcggccgcacccgtttcagcgccaatctgggccggttggtcaacctgggcttcatcgtgcgccgcaaccgctggctggacgaggggccgatgctggacttgatgatcgactacgcgcagctggcgccgcgcatcatcgagggcgcgctggccgacgtgctgctgcggcgcgagggccgcgacatgttggtggataagcgagtcgacgacgaaatcgaagaagaaggcgcggacgacgacatggcgtcggccggcccgctgtttgagctgccgccggacgacgcggccgacggggaggcgcgctgatgttccagatgaaatcggtggaaatggtgcattgggacttctggcagcggctgagcgtgccgctggacgcccagattgtcaccatcatcgggcctaatggctccggcaagaccaccttgctcgacgcgatgcgcacgctgctggcgatcaaatgctccggcaagcgcgactacaagcgctatgtgcgcaacaacaaggaagccttcgcctatctgcgcggtgtggtcgacaatccgcgccgccccagcggcggcctgtatccgacgccgttcttccccatcgtgtccgagtcggtgacgctgctgtgccggatcaagaagcagggcggcgactgggtgcgccactacgcgatcctggacggcgacatcgcgctggagcacgccgagggccaggcgcaatggctgggcgtgcaggaatatcgccgccggctggaagccgccggcctgaccccggcggtggccgaggtgctggcgctggagcagggcgacaccgacaagctgaccgaatacagcccgcgccaattgctggacctggtgttccaggtgttcggcgacaaggacgtgctggacaactaccagcgcgcgcgcgacgagcagcgcgccaccgagctggagctggaggcgctgagccgccaggaagaggcgctgcaggtgcgggtggaggcgatgaagaaccgcgccaaccgctatctggaatggaagcagctgcagaccggcatcgcccggctgcgcgacgaagccttgccggtgctggcctatttggacgccaagtcatcgtttggcaagcagtggcatgactaccgcggcggctaccatgtgctgaaccaggcccgcgccgagcatgccgataccctggcgctggtggccaagctgaaggcggccgaggtcagcgccagcgaggcgcgcggcgcggcggaaacggtgcggctggcggcgcaggaagccttcatgaaggccaagggcgagcacgccggcgtggcgggccagctgaaggagcgcgaccggctgcaagcgctggccggcaaggagtacggcgccgacgccgcgcagctggccgacaagctctctgccctgcgcgccgaggcggagcaactgaaggacggcctgcgcgggctgaaaaagcagcgccaggacagttccgagcatctgcaggcgctggaggtgggccgcggccgctcgccggaggatgtgcgccagttcaaggcggcgctggacgaggccggcattgcccacgcgatgctgtccgacatcgtcgaggtgatggattccaattggcagggcgcggtggaggccttgctgcgcggctaccgccacgtggtgctgctggacaaggagtccgatcgccgcgaggcgtggaaaatcggcgaaaagctgcgctatcggcacttcgtggtgccggaacgcgccgcgccgccgcgcgccgccaagggcagcctgctggaagtggtgcgcttctctgccgacgcgccggaatggctgtaccggcagatgaacagcgtgacgcgggtggagaacgcactagaaggcgctagcgctgaaggagactggatcacccgcgacggctatttccgcgagcgtcgcggcgcgcgccacatcggcgtgccggcgcacgagtacgcgttcggcgaggcggcgcggcagtcgcggctgctggcggtgcgcgacgaattgaaagcgctgaatgtgcgcatcctgggggacgaggagcggctggtggccgccacccgcgaggcggccggcttggccgagtacctgggcggcatggacgccatccgtcaactcgacagccgcgccgacgagttttcagcgctggaatcgcgcaaggccgagctggaagccgagatcgcccgccagggcgcggcgctggccgacgccggcgcggagaaggacgccgccgaccagcgccacggcgacgcgcggctggcgcacgaccgcgtctgccagcgcgagatggaaagcctgtccaagtacaagcagaagctgcaggacgtggaacaggcgcgccgccagttgcgccggctgatcggcgagctgcgcgagtgggccgagcgcctgccggacgcggcgctggcggcggacaacgtcgccgcgctcgaaaacgagttcgacaccgccgccgacgctcgccatcagctgagctatctggaagagcgcttgcagaacggcgactgggagcaggacgaagcggtgctgatgctgaaggacaagctggtggacgacctgacccagctcgaccgcgagcgccagcgccgccagggcgaggtggatcgttcgcgcgagctgaccgaggaggcgcgcgccgcctatatgggcaagctgcgcgccaccgtgcgcgcttacggccagaacgtgaagcggctgggcgagctggccggcatccaggtggaagtggagctgccgcagctgtccaacgacgacgcggtgctggcgcaggccgggctggtgttgaagttcaacttcgaccagaagggcatgatgggcatgaacgacggcgaggcgtcgggcggccagcaggtgatgaagtcgctgatcctgttgatcggcctgatgatggacgagtccaatccgtccggcttcgtcttcatcgacgagccgttcgcccacctcgacatcttcaacatcgaccgcgtggccggcttcctcaaggcgacggaagcgcagtacctgatcaccacgccgaatacccacaacatcaatatcttcgcgccgtcggagctgaccctggccacccgcaagaagcggcccggcgaaacctgggcgccgccgattctgcagacgcggcgccgggtggatggcggcgagcaggcgtaaacagcaacggggcggcgaaagcggccccgtttttcacgcatgggcccggactgcgcggctcagccgcccagcatgccagccagcttcggcagatctgccgcctgccaatcccaatcctgccgatcgccggatcgctcgtctgttcctggcagaacgctcgcggccgggcggcgaaggcggtgcgggggccgcagcggcgcgcggcggccaggtcgccatcgcgcgccgccaccaggcaaacgcgctcgggcggcagatcgagcagcgctgccgtgcgccgataggcttgggggtgtgaaccgctagcggccgctacacgcttcctccatcgtcggcgaataccgtgcgcaccaagcggtggcgcaggcgcaagggctttgcctggcgcgaggcggagtcagccgtttccgctcaggcgggtcgggtcggcgccttgccaccagtccggcgcggcgctgccgtcgccgatatggccgtcgcggcgcagatagtggcgaatgtcgcggccggcttcgcgcagcgccgggtcgccgttcaacgcccgctccagccattccgcgccgtagcggaagacttcggccgccacgccgcccagcgggtggaattcgttttcgtagacgcgcatctccttgggcgcgcggatgcgctggtagcaggccagtgcctgttccagcggcgtcagctcgtcgaattcgccgatgccgagcagcaccgggatgcggatgtcggccgccagcgcgcccagcggcatttgatcgcgcaggtcgcggtcgaagcgggcttcctcctgatagccgctcatatacatgtagtttttcttgaagctgggttgggcgcgttcgaagatggtgaggaagtcgccgcacaccggctcgtaggcggccagcgcggccagccgggtgcggccggcggccgcgcgcagtccccaatagccgctcatgctgatgccgaacatgccgatgcggccggcgtccacttcgggcaggccagccaggtagccggcgtaggcttccagcgcccgctcatagttatccagggtgacggtcaggccgccggcgcggctttcgccctggccggggccttctatcgacagcgccaccatgccgcgcgaggtgtaatagcgctcggcggcgtacagatagtcttccttgatcatgtccatgccggggccgaggatcaccgccgccgcctggcggacttcgccgtcgggcaggtgcagcaaggcgtggatgacgccgccctcgaatggaatttccacccgccgcactcggcccccgcgcagctcgccgatgcgctccacgcaatgattgcagcgcgcgcgcaaggcaagcttgcgcggatcggcggcatcgaagatcgagtactgggcgcggccccacatcaccgcggcgcgcagatagaggtcggcggcggtgcggcggtagccgtcgcgctcgtagtgggcggcgcgccgttcggcgcgggcggccacttccgcccaggccttgggcagcatcgcgccgcttttcacctgcgcgaacaccgcgtcgaaatccgccgggtcgtggcccagctgcagcagggtgttcttgccttccgggtgcagggcgtcgaaaccgccttgggccagcgcgatgtccagcgaccagctttgcgcttctgaacgtgacataattttcacctcgtatattgatcgtaccaaaaaataactaagtacttagttatattattgcggagccggaacccatgtcaaccaagccccaaggggacgctgcgtccagcgcggccgaagacgcccgccgccaggcgctggcgcgtctcagccgcgccgcctacagcctgagcgccgccgacgcgcggctgcgcggccgcgccacgcgccaggccggcgcgttgtcgctgtcgcatgccagagtgctgcggatattggccgaggagggggcgctgccggtggcgcggctggccgaactgaccgagaccaccggcgccggggtcacccagttggtgaacggcctgagcgagcagggctatgtggagaaggcgaagtccttgctggacaagcgttcggtgctggtgcaactgaccgaactgggcctggcgcgccatcgcgagcgcgagcgtttgctggccgaggtgctggagcgcgcgctgcgcgatatggacgagcggtcgctggacgccgccgccgcggtgctgcgcgcgctgggcggcgtctacgaccagttgtgagggtggtcaggctttcaggttctgttgcgcgaattcccagttgaccagcttgtccagcaccgcgttgacgtaatcggcgcggcggttctggtagtccaggtagtaggcgtgttcccagacgtcgacgttcagcagcggcgtcaggccggcggtggccggggtgtcggcgttggcggtcttcaccacgcgcagcttgtcgccgtcctgaaccagccaggcccagccgctgccgaactgcgagatggcggcgccggccagctgttgtttacaggcatccacgctgccgaacgacgcctcgatccgctcgcgcagcgcctgcggcggcgctccaccggccttgggccgcatgctgttccagtagaaagtgtggttccatagctgggaggcattgttgaagatggcggcgtcgccggcttgcttggccgagcgggcgatgatgtcttccagcgacagatcggcgtagtcgcggccggctgtcagtttggccaggttgtcgagataggccttgtgatgcttgccgtagtggaagcctatggtgcgcgccgagatcaccggctccagcgcgttgtcggcgtagggcagcggcggcagcgcgtgcgcggaggaggcgcgggcgcgcggcgaccacgcgggcagcgcgatggcggccaggctgccggccgcggccagcagaaagccgcggcgatccagttccggctgcgcgcggacgatgggcgagtcttgcatctgaattctccctgatgaggtgggcggagccgcgccccgctcggcggcgcggcctgcaaaagcatattaatccagcatgcaagcacggttggcggcattgcgccgccgggcatggcagtacggacaggccggcggcgaaaatgggcaaaccgccaggcccggaggcgctggcggtcggcgcgatggcctgcggcgcttagcgcaggttcagcgacttcgcggcgtggcgcagctcatcggacaaatggatgtcctggccgctcacttcggtccagtggccgttttgcaggaaggcgtagcgggccttggagccggcgtcggcctgccagccgcccttcagctggccgtcgaagtggaagtcttcgcccagcggcgcgtgcgcttgctgctgcggatgctggccttgggcctgcggcagctggtggccgaagaggaacagctcgatattgctgccgttttcctcgtaatggccttgcaccgggctcttgaataccagcggttgggcggtggcgtgggtgatgacggcctcgccgctgacgcggcgagacggcggataaaccgacagcttcaactgcagcttgtagccgccgtctacgcccggtttgaaaacgttgtagctgacgatgaacaagccggccttttgatcgcgatccagttggttagccatgatgtggactcctgtgaaatcggatgacggttgatggcgccggtaagcgcgcatcccatttgcttgccgtggcgccacggtagcggcgtcacccgctctttatataacgaatggttttatttttcgccgccatttaggccagttgggcatttagtgcgggtggggatggtcggcggccgggcggtatccacggcaaccatatcgggcatggggttgcattccgccggctttgccccacactagcgccatccccaaccctgaaaaggactgagacatggcaactgttaccctgcgcggcaatccggtggaagtggcgggcgcgctgccggccaaaggcgccgcggcgccggcgctgcaactgaccggcggcgacctggcggaagtgacgctggatacctacgccggcaagcgcaagatcctcaacatcttcccgagcgtggatacccccacctgcgcgatgtcggtgcgcaagttcaacgagaaggccgccggcctggccgacgccgtggtgctgtgcatctcggccgacctgccgttcgcgcaaaaacgcttctgcggcgccgaaggcatcgagggcgtggtgaacctgtccaccttccgcaatccggccttcgccgaagcctacggcgtcaagctggcctccggcccgctggccggcctgaccgcgcgcgcggtggtggtgctggatgccgacaacaaggtgctgcatagccagctggtgggcgagatcgccgacgagccggactacgccgccgcgttggccgcgctgtaagcgtcggcttctggcaaaagaaaaagccgcccgggagggcggcttttttcatgggcgaggcccgcgggatcagccgcgctggacggcgggcttgccggacggctggttttccgcctgcatcgcctccaccagcttgggatcgtgctcgtcgcgaaggtagcgggtgtaccagccgctgttgacgccccagaagtagaagcccagcgaagcggcggccaccacagccatgtccacgccgtacggcaggatgccgaggccgccgaagtcggtgctgccgatccaggacagcagcgccatcgtcggcaggtagagcaccatccacatcgcgcccttcagctcgcgggagaattccggccagccggccttggcctggtaccagatgtagaccggcagcgcggccacgatcaggaacaggatctggccggtcagcggccagcgcgcccagtacagcaccagcgaggcgcagacgaaggcgaacggcgcgacgatgttcaggccggccaggcgcagcgggcgcggtaggtccggcgcgcagcggcgcagcgcggcggcgctgatcgggccggtcaggtaggagatcacggtcgccaccgagatcaccgccgccagcgtgccccagccgcggaagaagaacaggaatacgaaggacaccgccaggttgaaccacatcgccggacgcgggatgcggtacagcgggtggatgcggccgaagatggccggcatggtgccgttgcgctgcatgccgtagatcatccgcgaggtggacgccatataggtggcgccggtgccgctggggctgacgaaggcgtcgaaatacagggtcatcatcagccagttcaggcccagcgccatcgccagctgggcgaacggcgagctgaagtccaggcccttccagccgtgaaccagttccgccggcgacagcgcgccgaggaaggccacttgcagcgcgacgtagatcaccgcggccagaaggatggagccgaccacgccgaagggcacgctcttgcccggattgcgggcttcgccggccaggttgatcgggctctggaagccgttgaagctgaacacgatgccgctggtggccaccgcggtcatcacgctggcccagccgaacggcgcgaagccgccgagcgccgggttgttcaggttttccgagtggaagccgctgtaaaccagcgcgcccaccgtcaccgccggcacgatcaccttgaagatggtgatggcgctgttggccttggcgaacagcttgacgccccagtagttgagcaggaagtaggcgatcaccagcaccgcggcgaaggacaggccgatggtgctcagctcgccgttgcggtacaggttgtgcgcccattcgtagggccaggtgctcatgtactgcaccgaggcttcggcttcgatcggaatcaccgacacgatggcgatccagttggcccaggcggcgatgaagcccagcagcgagccatgcgagtagcgggcgtagcgcaccatgccgccggattcggggaacatggcgcccagttcggcgtagctcagcgcgatcgaaagaatgatcaccatgccgacgatccaggcgacgatggcggccgggccggcgatctgcgcggcgtgggcggcgccgaacagccagccggaaccgatgatggaacccaggccggtcagcatcagcgcaaccgggccgatgtggcgggagtgttgttgttgcaagggcgaatctcctgtcatttgaacgatgacgggcaacgactctgccggggcggcgcgcacgcgccagacgtgtccggaggaggttgcccacatagccgggtgggcccggtcttatgtaaatcgcgcctgcctgctgggcaggcggaccgcgtcggcggaagcgccgcagcggcctggggggtcgaaacggccggcagcggccgacgacggaaatcatgatgttgcccccgactgcgggcgtttctctgaattttgtccgacatatcgacccgaattttcgggtgcgcggattgtaacgtaatgtgaacaatttttgctacaacttatatgtcttgaaatctttgtgtcatcaatggcggctacgatggggtccccgaagtctcacgcagtacccgccatgtctctgatcaaacgcttgtggctgaccatcgcctttaccctcgccagcttggcgctggtgatatcggtcaccgggcagcagctatatgctttcacccgccatgtcgacaactacaaccgcctgcagcaactggccagcgatttgcagcagctcaaggccatcgcgctgtcgttcgcgcgcgccgatcccctgctgccggaaaccggtttgcgcttgcaggcggcgcagcggcaagtcgctgatttgcaacgggatatccagtccaacttgccggcggccgacggccaggccttaggcgcggcgttgcgcggccactggcaggcttacgtccgcaacctggccagcgccatccatatcgccgaaaccgcgccgcaggacgcgctgtcgataccggagcaggcatatcagcaggacctggcgccgctggcggcgcagatcgacagccaggtggccaggcgcgacggcgagctgcggcgcgagaaagccgagctggcggccgcgctatcttggctcgcgccgctgatcctgggaccgctggccttggccagcgcgctggtggtgctgatccagctgacgctggcgcgccggctcaagcgccatctgggcgcgatggccagggccgccgacgcgctgagcgagggcaatctgggcgtgcggctgccggatagcggcggcgacgagctggcccatgccgctgcgcgcatcaaccgtttcctggaccgactggccgggctgctggacgaggtgcggcggcatgccggcgacaatctgcgcgacagccagcgcctgcagctgctgacgcggcagagcgccgacgccagccggcagcagacgcagaaaagccggctgagcaacgaggcggcgggcgagatcgccggccacgccgaaagggtggcgcagcatgtcgaagcggcgcaggacagttcgcgcagcgccgcggcggtcaccggcggcgcgcgcgagctgggcggacgcaatgtcgccaccatgcagcgcttggccgaacgcatcgataccgccacccgcgagatgcgcgagctggggcgggcggtgggcgccatcggccagatcagcgcgctgatccgcgaggtggccgaccagaccaatctcttggcgctgaacgcggcgatagaagcggcgcgggccggcgaggccggccgcggcttcgcggtggtggcggacgaggtgcgcaagctgtcggagcggacggcggcggccaccagcggcattttcgacagcctgcggcagatggagcgcgcgcagggcgcgctgggcgaggcgatcgccgccgccggcagcgccagccgcgacagccaggatgcgcagctggccttggagcaggcgctggatacggtggacggcgcgctgtccggcctggccggcttgatggaggacattagcgacgcgcgcgagcggcaaagccgcgccggcggcagcatccgccagcatggccacgagcttgccagcctggcgcacgacatcgaaagccagatggggcaggcggagccgctgatgctgcagctggcggcgtcggccagcgggctcaaccaggctttggcctggttccgcctgccggcggcggcgcgcggcgcggatacgcaggttcgcttcgctgcgcccgccccggcgccgcgctgacgctcagcgcggcggctggaaggagacggcttccacccggcgcttgggccgcaccaccaccgtgcgcgccagcttgtcgtgccagccttgcttgcgcgggtccagccccacccagatcagcccgacgcagaacggaatggcggcggcgaaatagccgaggtagcgcagcaccgcctggccgggcttcagcgcctggccgctgtcggcgtccaccacccgcgcgcccagcatcatcttgcccggcgtggcgcttttgtagagccagaacaggatcaccgccagcgccggcagcaggtagttggtcaggatgtcgcccaggccgccgatgccgagcagcgtggagaaatccagcgtcccggcggccggttccggcgctgccttcggctccagcagccaccatagcggcagcgaggcgatcaagagcagcgcggtgtcgaccagcgacgccagcgcgcgcagccagaaacccacgtattccagctcttcggcgtcatgcgcctggggtgtcggatgcatggctcagtcctccagattggctttgtgcttgtcggccacgcgcagatagtgctcggcggagtacttgaagtaggccagttccttgtcggtaagcggccgcgcctgcttcaccggattgcccaggtacaggtagccggacgccagccgcttgcccggcggcaccaggctgccggcgccgatcagcacccggtcctcgatcaccgcgcggtccagcacgatgctgccgatgccgatcagcacttcgtcgcctatggtgcagccgtgcagcgtcacatggtggccgatggtgacatgcttgccgatgatcagcggcgcgccggccgggtcggacgccgtcttgtggctgacatgcagcatggcgtggtcctgcacattgctgttttcgccgacgcggatatggttgacgtcgccgcgcagcaccgcgcacggccagacggaggcacccttctccagcgccacttcgccgatgaccaccgcggcagggtcgatgtaacagccggcggcgatgtcgggatggtggccgtcgtacgggcggatattgcttttcatcgttttgtcctcatctcggtcatgaccgaattgtgccggcgccgcccggcggcgcgcaaattcccctatcatatcagcctcaccaaacaggacgttgaagccatgagccagaaccccctactcgatttttccggtctgccgcgttttgccgaaatccgccccgagcacatcggaccggcgatcgagacgctgcttgaggaagcgcgcgccgcggtggccaggctgacggcggagccgggcgagccgggctgggacagcttcgtgtcgccgctgaccgacgccaccgagcgcctgtcgcgcgcctggggcgtggtggggcacctgaacgcggtggtgaatacgccggagctgcgcgaggcctacaacgccaacatcccgcgcatttccgaattctggaccgagatggggcagaacctggacctgttcgcccgcttcaaggcgctggccggcggcggcgagtacgcgtcgtacggcgcggcgcgcaagaagatagtggaaaacgatctgcgcgacttccgcctgtccggcgcagaactggacgacgcggccaaagagcgcttcgccgcgatccagacccgcctggccgagctgtccgccaaattcgagcagaacgtgctggacgccaccgacgccttcaccctttatctcgacgacaaggccgagctggccggcgtgccggaagacgcgctggagctgttcgccgccgcggccgagggcgacggcaagccgggctacaagatcacgctgcagttcccgttctacttcccggtgctgcagtacgccgacaaccgcgcgctgcgcgagaagctgtaccaggcctacgtgcagcgcgcgtccgaattcggccccgccgagcgcgacaacggccccatcatccgcgaaaagctgcagctggcgcgcgaagaggcgcagctgctgggcttcgccaatttcgccgagctgtcgctgttcaccaagatggcggaaagcccggaacaggtgatcgccttcctgcgcgacctggccgccaaggccaagccgttcgcggtgaaggatcgccaggagctggaagccttcgccaagtccgaactgggcctggacacgctgcaggcctgggacctggcctacgcggcggaaaagctgcgcgtggcgcgctacgccttctccgagcaggaagtgaagcagtacttccccgaggccaaggtggtgcagggcctgttcggcgtggtgaacaagctgttcggcgtggaagtgcgcgacagcggcgcgccggtctggcacccggacgtgcgcttctacgacatcctgaaggacggcgagctgctgggcagcttctatttcgacctctacgcccgcgacggcaagcgttccggcgcctggatggacgacgcccgcggccgccgcctgaagggcgacgcgctgcagacgccggtagcctacctgacctgcaacttcacccgcccggtcggcgacaagccggcgctgttcacccacgacgaagtcatcacgctgttccatgagttcggccacggcctgcaccacatgctgacccgcgtcgacgagctgggcgtgtccggcatcaacggcgtggaatgggacgcggtggagctgcccagccagttcctggaaaacttcgcctgggaatgggacgtgctgcagggcatgaccgcgcatgccgaaaccggcgcgacgctgccgcgcgcgctgttcgacaagatgctggcagccaagaacttccagagcggcatggccaccgtgcgccagctggaattcgcgctgttcgacctgacgctgtacagcaacttcgacgccgagcgcggcgactggctgcagctgctggccgaagtgcgcgccgaggtggcggtgaacatcccgccggcctacaaccgcttccccaacagcttcagccacatcttcgccggcggctacgcggcgggctattacagctataagtgggccgaggtgctgtcggccgacgcctacgccgcgttcgaggaagtgggcggcgccgacgccgagaccggcaagcgcttctggaacgagattctggcggtcggcggcagccgtccggcgctggagtcgttccgcgccttccgcggccgcgaccccgaaatcgacgcgctgctgcgccattccggcatggtggcggacgccgcgtaaaaaaatcggaaacttccggaactccccggcgccgcgctggctctaatcacttgctcagggttgtcttccggagcagcaagcgagccagacgcgtatcaggggtagtgataagtgtctattacacgcctccgcggcatgcgggggcgtttttttatgcgccgaaccctgcacagccggccgcgctgctgctatggtgtcggcctttagtccctttccggagaacccgccgatgcgctttgccacctggaacgtcaattccctgaaagtccgcctgccgcaggtgatccaatggctggccgataccggcgtggaagtgctgtgcctgcaggagctgaagatggaccaggacgtcttcccgctggccgagatcgaagccgctggctaccgcgcggtctggttcggccagaaaacctacaacggcgtggccatcctggccaaggcgccgctggagatcgaggacgtggtgtccggcattcccggctacggcgacgagcagcgccgcgtcatcaccgccaccatcgccggcgtgcgcacgatctgcgcctatttcgtcaacggcgaggcggtggactcgcccaagtacccgtacaagctggaatggctgtccaagctggaaggccatgtcgccgccgagctggccgcgcatccgcagctgctcttgctgggcgattacaatatcgcgccggaagaccgcgacgtctacgaccccgaaggctggcacgagcaggtgctgtgcagcacgccggaacgcgaggccttccgccgcctgatcggtctgggcctgtccgacagcttccgcctgttcaaccaggaggagaagcagtacagctggtgggactaccgccagatgatgttccgtcgcaacaagggcgtgcgcatcgaccacatcctggtcagcgacgcgctcaagccgcgcgcagcgtcctgcgagatagacaaggcgccgcgcaagtgggagcgcccgtccgaccacaccccggtggtgctgacgctggccgactgattccgcttcggcgacggacgcgcgacggcccggctttgacgccgggccgttccttttggcggggccggcggctgtcgccggacgctgccggcgcttataacgatgatggaatatgccttccgggtggtcgggccaaggtttggcctggctcaagccggcgggccgcgccgcttgctaagctggtttcgtcactcatccgccggtaacccaccatgaccacattgcatacccgcgccagcgcgggcgacccctactatcaggacgtgcccgcctacatgaccgaggtctacgactgggcctacgtcaatccgcgcaaggccaggctgctggaccataagctggtggtgcgcacgctgctgttcggcaacgatcagcggctgatgcgcgcctatctcgatgaaatccggcccggggagcgggtgtggcaggtggcgcacgtctacggcgacctggtgcagcgcgccgccgcgcgcgtcggcgaggccggccgcttcacgctgaccgacgtcacgcccatccaggtggaactggccgcgggcaagctggccggcctgccgcaggccgaagtggtgcgcgccgacgcggcccgctatcacaccgacggcaagcaggacctagtgtgcagcttcttcctgctgcacgaggtgccggaggagatgaaggccgccatcgtcgacaatatgctggcccaggtggcgcctggcggccgcgcgctgttcgtcgattaccaccggcctcagccgtggcagccgataggctggctgctcaaatgggtgaaccgcgcgctggagccgttcgccgaggcgctgtggaaccaggagatccgcgcctacgcgcgcgaggcggagcgtttcgactggagcaagcgcacggtgttcggtggcgtgtaccagatcgcgctggcgcggcgcaaagactgaaattgcggcatgtacgtagcgttacatggccttacatgcgactaacagacggcgggaaggggcagggctaggatacgtctcaaggaaacaccaaacacggtgcctccggaaggccgaaagcctccgttaccgacctggagatgaatcatgaaaaagctgacccttcttgccttgtccgccgtatttggcctgagttccgccgctggtttcgccgctcaagccgttccggcctccgccccggccgccaaggtagccccggccgccaagaaagttgaaaagaaaaccccggccaagatccaccacgccaagaaggccgagaaagtcaccgcttccgcccagaaggcccaggcagccaaggctgacgcctccgttccggccaagaaggtcgtgaagaagaaagtcggcgtgaagaagcacgcttccgctccggccgcgcaaaaagcccaagccgccaaggccgacgcttccgctccgaaagccaagaaggctcacaagcacgccgccaaaaagcatgccgccaagaaagaagcttccgccgcgcaaaaagcccaagccgccaaggccgacgcttccgccccggtagccaagaaggcgcacaagcatcacgctaaaaagcacgccgccaagaaagaagcttccgccgcgcaaaaagcccaagccgccaaggccgacgcttccgccccggtagccaagaaggcgcacaagcacgccgctaaaaagcacgctgtgaagaaagaagcttccgctcagaaagcccaagccgccaaggccgacgcttccgctccggtagccaagaaggcgcacaagcatcacgctaaaaagcacgccgccaagaaagaagcttccgccgcgcaaaaagcccaagccgccaaggccgacgcttccgctccggtagccaagaaggcgcacaagcaccacgctaagaagcacgccgccaagaaagaagcttccgccgcgcaaaaagcccaagccgccaaggccgacgcttccgccccggtagccaagaaggctcacaagcaccacgccaagaagcatcacgtggccaagaaggctgccgcttcggccgccaagtaatcaaaccagactccggtctggctcgcataaaaactagggaggcttcggcctccctttgttttggctgcctggcatcgcgacaggcggtttgatttttccgtcccgacaaagaaacagccccgcggcgcaagcctgcggggctgttgtcgttccgccgaggcggagcgcttatttctcgacgaaggcgcgttcgatcgcgtagtcggccggctcgcccatgcgcggcgattccttgaagcccatgccgttcaggatttcgcacaggtcgtgcagcatgctcgggctgccgcagatcagcacgcggtcgtgttccggattcaattgcggcaggccgatgtcggcgcacagcttgccgctggtgatcaggtcggtcaggcggccttcattgcggaacggctcgcgggtgaccgtcgggtagtagatcagcttttccttcaccatgtcgccgaagaattcgttttccggcaactcctgggtgatgtagtcgtggtagcccagctcgctgacccaacgcacgccgtgggtgaggatcaccttgtcgtagcgttcgtagacttccggatccttgatgatggacatgaacggcgcgaggccggtgccggtggacagcaggtacaggtttttgcccggcagcaggttgtcctgcaccagggtgccggtgggcttcttgctgatcatcacggtgtcgcccaccttcaggtgctgcaggcgggaggtcagcggaccatcttgcaccttgatgctgtagaactccatgtgctcttcgtagttggagctgacgatggagtaggcgcgcatcagcggcttgccgttgacttccaggcctatcatcacgaactggccgttgatgaagcgcaggccggcgtcgcgggtgcaggtgaagctgaacagggtgtcgttccagtgatggaccgacaggactttttcagcggacaaattgggagaggacatatctcgtgcggctcgctatccaaaagatcgaaaaatattgcgttgcaaggattttaacccgtttcgccggccccctgcttgttcctgcggcttcgggtatcgcatggcggcgcggacgctgtccgcggctgccgtttgtgcttgggacgacgccggcccggatgggcggacgctatcgtgagtggagctgggccaggatttcaggccaagcgtgatggtcgcatgttaaccgacagcggccaatctctggaagattgtttgacgatttttttagcaccggcagttatttgtctgagcaatatcaagcttgtatctccataaggaagagggcgtcccggtggtgggacgccctctttggacttactgagacgaaacatcgcagtcgcgcctgggaaccatcatgaaacggcgcggagcggattcactgcatcgcatgccgctgcaaaggcatgctcgttgaagcctggaacagattgccggtgctttacgattcacgatactgccggcacatcatcctgccctcgatgggcgtgtaagcggaaacggcgtttccgtggtcttcaatcatcaacttcccgcgtgctcgtcatgaatctgcaagtgatgtctggctgaccggcggcctttggataatccgcgcatccgtcctggatgctgttttgggcattgctggcaccgatggtgtcgaccgcgcgccggttcagtctggggcggtcgcaatgccgggttgagcgcaaggtggccgggtattgtcgcctgacacatccgtctcccttccggttgcttcaacttttccaatatagcgcttacagctgctgaagcaaggattttttaatccgccgcggcctgcggcgcgggcgccgcttccggcgggttgggcttgagatgggattcgaattgccggctggcggcttgccaagaatagcgctccgccacctggcgcacatggccgcggtcgatttccagcgcttgcaggcaggcggcgcgcaggtcccaatccagcgcgccggcgccggagtcgcccaccacgtccagcgggccggccaccggaaacgccgccaccggtgtgccgcaggccatcgcctccagcagcaccaggccgaaggtgtcggtgaggctggggaacacgaacacgtcggcggcgcggtagaagcgcgccagctcgtgttgcggaaacacgccggcgaaatgcacttccgggtattgctgtttcagccgcggcaagagcgggccgtcgccgaccacccatttgcaaccgggcaggtccagcttgaggaaggcctcgatgtttttctccaccgccacccggccgatgtagacgaagcgcggcggttcggtgtcgtccagccgctggcgctcgccgggggtgaacagcgcggtgtcgacgccgcggctccacagcctgacattgcggaagccgcgctgctccaggtcgtcggcgatggagcgggtgggcaccatcaccgcctgcgaggcgttgtggaagcggcgcatccaggcatagctgatggcgagcggcagccggcagcgcgcctggatgtattccgggaagcgggtgtggtaggcggtggtgaaggccaggccatggcgtaggcagtagcggcgggcggccaggcccagcggcccctcggtggcgatgtggacggcgtccggcgcgaagccggccaggcgctgcgccacctggcggtaaggcagcagcgacagccggatgtccggataggtggggcagggcacggtgcggaattccagcggcgtgatcatgttgacctggtggccgaagccgtccagctcgcgcacggtttcggtcagcgagcggaccacgccgttgacctggggcttccaggcgtcggtgacgatcatgatgcgcatgtggattcctccgaagggatgggctctggcgattcctcgatggacgagcctatggtcagcgccgtccagtgcagcacttccagccggccgtcgagatgctcgaccagcgccgacaggctttccacccagtcgccgctgttgccgtagagaatgccgtctatcatccgcacttccggcttgtggatgtggccgcacaccacgccgtcaaagccgcgccgccgcgcctcgccggccaggatggcttcgaactggctgatgaagttgaccgcgtttttcactttgtgtttcaggtattgcgacaaagaccagtagggtaggcccaggtgggtgcgcacccagttgaagccgcggttcagctgcaggatcagcgtgtacagattgtcgccgacataggccagccacttggcgtactggatcacgccgtcgaattcgtcgccgtgcagcaccagcaggcgcttgccgtcggcggtgaggtgctcggcctcgtggcggatggagatgccgccgaaatccagcccgcagtactggcgcgccgcctcgtcgtggttgccggggatgtagatcacctggcagcccttgcgcgccttgcgcagcaatttctgcaccacgtcgttgtggctctgcttccagtaccaggatttcctcagctgccagccgtcgacgatgtcgccgaccaggtacaggtagtcggattcatgttcgcgcaggaagtcgagcagatggtcggcgcggcagccggcggtgccgaggtgcacgtcggaaatccagatgctgcgcaggcggcgcgaaacggcggaggcggagtctggctgcatggcggtgtccgtgggccggggcgatggcccatgctgctggggcaaggtgacaggcggatgagactttgttgacagcgcgatgaattgattggcgtgggaaaggcggaaaccgcgagcgggcggcggggggcatgcgcgccgggggagggggccgccagcgggcgcggcggcgttgccgcgccgccacaggagggccgccggagagaagccagcggcgcggaacgatcagcccgccatcgcctggcggcggttgctgtaggcttcgcgctggatgtcgcgcacttcgctggtgatcatcgccacttgcggcaattgggcgcaggccgcgcgggcgacggcgtcggccagctgttttttctgctgctcgctgcggccggccaggatgtgggtggtcacgtgcacaaaggcgtcgggctggccgcccaccaggtagtgcgccgagggcagcacccgcaccttgatgtcgggcgtttcgaacaggccgctggcgacggcggcctgatgcacggcttgcatcagcggcattatctgcggcgcctgcgccagttcggccgggcattcgatcacgcaatggggcattttcttctttctctagttctcgtgggggggtagcggcttgccggccccgaagcgcatgcgccagaacagcgcgttgcagacgccgccggccatcgctcccaggtacatcgtcatccagtcgttgtacagcagcggttcggccacgcgggcgtacagcagcgtgatcaggctgccgctgaaggcgccgggcgcgaaggccgccagcgccagcagccaggccggccacaggctttgccagcgggcgatgggggcggccaggatgatgcgcagcaggcacagcatcaggccgaagatcaaggccggcaccgcgcccatcaggtaggccatcatcggcaccacgccgctggccaagagcgccaccagcgggcccagcaggatgaacagggtcaggccgcaggccaggattttcaggtagggagtcttcatccgcgctcaggggaaggcaaaagatgaccagcgtagcagactggccggccggcgacgagtgccggcgtcatcgccgcgcggcggcgaacgggtcggacagccgcggatcccgggtcagggtttcgtcgctcagcgttttcaggaaggcgacgatgtcggcctgctcggcgggcgtcagcctaatgcggccgatggccgggtctttccacggattgcggcggccgtcgcccagcttgccgttgtcgcggccgccgtcggcgtggatgcgcaccgcgtcctccagcgtcgccacgctgccgtcgtgcatatagggcgcggtgagcgcgacgttgcgcaggctggggctgcggaagcggcccatgtcggccggcttgccgctcaactccagcgcgccgcggttgggaaacgggtagctacctttgccgtcggcgttgtagaggccgatgttgtggaagggcaggccgtcgccatggccggccatctggtcgtcgaagtccggactgccgtggcagcgcaggcactggctcttgtcggcgcggaacaggttcagcccgcgcagctcggcggcggacagttcggccttgccggcctggtagcggtcgtagcgcgagtcgaaagatacgatgccgcgctcgaacgtggcgatggccttgacgatattggccaggctcaggggtttttcctcaccgggaaacacacgggcgaattcgctcgcatatcgcgggtccgagcccagccgggccagcaccgttggcaggttgccgtcgttgatgcccatctcaaccggctcggtgcggaacagcgggccgtccatctgccgctccagcgtggtcagcgaatagttggcccaggtgtagcttttgcgccaggcggcgttggccagcggctgggcgttgcgcagggtgcgctcgccggtggcacccagcgacagcgcgacgccgtcgctgaaggccttggcctgcggatggcagctggcgcagctgatgctgccgttgccggacagccgcttgtcgtagaacaggcggcggcccagctcgaacttagcctggctcatcgggttgtcggccggcaccgggggcggagacacgctgggcggcagccgccaatgccagtccccgaccggggccggcggcggcgcttcgcggccgcaggccgccagcagcgcggccaggagcagcgcggcgaacggtctcatgaggcggccttttccaggcggaacacgcgcgggttgcggccgtcgcccagcggctggccgccgtcgccggcgccgggtcggctttcgttcagccgcaggcccaggcgatcgaagatgggctggcattcggcgtcggtggcgttggatttgcagccgaagtcggcgctgtcgtcgcggctgatgtcgttgccggcgaacagcgattgcacgtccagcaccacgcggtcggcttgcggatcgaagcggtcgaacctcaccttgaagcggttgggtttgccgcagcggtagccgccgacgatggcgctgtcggcctggcagtcggtggagccaaggtggaaggcccagcggtcggcgctggagccgtcggcgcgcttgacgccgccgctcggggccaggtcgatgcgcatgaagcggtggccggactgccattcccacatcagccagtacacgccgaggatcgggtgcggcgggctgtgcgccggctggtggttcagcgccacctcctcgcccttggcgttcttggcggagatcggcacgcccaccttgaagctgaggccggtgtaggtatcggccggcacgctgcccgtcacctcgctgttgctgcccggcagcggcttgcccaccggcgtgtcgccgtcgtcgcgcgccgggtccttgcagctgccgccggcgaagtccagcagggccaggttcagatactgccatttattgccctggtccagctgcagcggcacttcctggccgcggctgttgaccagggccacgtcgtggacgtagaccatgccctcggccagcgtggcgttggcctggccgacgcccatgccgctaagctggctgttgcagctcaccggctggctgccggatttcagcgcgaagcggacggtggtgttgccgccgccgtagccggggggcggggtctgattctggttctggggcgggctgtcgctgctgctgacgccgccgcccaggcaggcggacaggcccaggcacagcccgggcacgaggatccagcgcttgttcatcacggttctccatttattgttatgcaagccgtagggcggatgccccatggggcgatccgccatcggtcgcaggcagtcgctttacgccgtgccccgcatgcgtttaggcgagcgccggtctgcttggcggttggcggcgagcggcggaacgcccggctttgccgggcttccgccctacgccaggcattaccagtgcgcctgcagcttcagccacagcgtgcggcccggttcgttgacgcgggtggtgcgggcatagccggccacgtcggcgccgccgctgctgatgtgctcggcgtaggcgcggttgaacaggttgtcgacaccggcggtgagcttcagcgccttattgacgcgccagccgccgttcagcgacagcgtggcgaagcccggcgtcgggccgatgtcttggctggcgatattgccctggccgatggcgtagcggtcttgcccggcggccacgcgccagacggcggcggcggcccaggtctggttgtcccaggccaggctgacgctggcgctcaggggcggcgtctgcgccagcggtttgccatcggtggtgttggcgccccagctgtaagcggcgctgccggacagttgccattgcggcgcgaattgccaggacgcgtcggcctcgacgccgtagcggtaggcctggatgttgcgggtggtctgggcggcgctgtcgtcgaccagcaggaagtcgtcgatgcggctcaggtagccggaaagcgagccctggattcgttcgctcttgtacagcgcgccgatgtcgagctgggtattgcgctccggctgcagcaccggccggctggcggcgacatagctgcgctcccagtagtccggcgcgcgctcggcgacgccgacgccggcgtagggcgtccagctgcccagtcggtattcgtagcgggcgaagccgctgaacagccggtaatcctgcagttgctcgccgcggccggcggcggcgtcgtagtaggcgcgcgcgcggtcgtggcgccagccggccaccagcttgccgccgcccaggggggtgtcgccttccaggtagaaaccggcgcgttcaatgtgttgatccggcacgcgcggcagactggcgtagtcgagcccgcccacgcggctggtgtggcggtcgttctgccagtccacgccggcggtcagctcgatgccggcgaacgccaggtcggcctccagcttggcggcgtcggtcttgcggtccgggttgctggcgcgcggcggcttgccggcggccagcggccgcagcgtgtagttgtccatcacgtggtcggcgtagctgcggttggcggtcagccgcaccgcatccagccacggcgccagattgcgctgctcggccttgaagccccaggcgcggcggtcgaattggctgccgtccatcatgcggtcggcgtaggcggcgcggccgttgctgaagtcgccggagatttccagcgtggtgtcgcgcgtcggcgtgaagccggcgatcacgctctggctgtcgcggcggtaggccgaatgcactttccggccgtcgccgtcgcggtagtcgccggcctggttgtgcgagtcgatcagccgcagatagccgagcttgccgcccgcggtcaggtcggcgtaggcgtcctggcggccggcgctgccggcgagcaggctgccgccgaagcgcaggcccggctcgtcgaacggcttggtcttgcgttcgaagctgaccgcgccgctgatcagcgcgccgccgtatttgaccgactgcggccccttgatcaccaccagcttgtcgtaggcgtcgggaaacaggtaggcggtgggcgggtccatccggcccgggcagccgccgtagacgaagccgccgttggccaggatgttgaggcgcgagccgcccaggccgcgcagcagcggatcgccggagctgccgcccttgcgcaccacgtcgaagccgggaatggttttcagcaggtcggcgccgtcgccggccggcaccggctgacggggcgcgcgcggatcggtctccacccgcagcggctggtcggtctggacggcggtgacgacgatgcggtcgccttggaaggtgggcaggtcggcggcaaaggcatggcataccgccagcgccagcggcaagggcagcagggaggttttcagcgtcatcgggaaagtgtgaatttgttttaagttcgcggcgatgctagtgcaaaccatcctggccaggaatgcggcatattgtcgcagcggctccgccggggcttggtggtaaagtggcggcatgatgcggaatccgatattcaggccgggacaggccgacgacgccgggcaggccggtttgcgcgtgcgccggctgcgctggctgatgctgctgctgggcttggcggtgctggccggctgcgcgctgcagcaggtggagctgccctggctgctggcgggccaggcgctggccacgctggccgcggtcaacctgctgctgccgcggctgccggcctgggggctggcggccgagcacgcgctgcggctggggctgctggccgacgtgctggtgctgaccgagctgctggccttcagcggcggcgccgccaacccgctggcctcgctctacttgccgccggtgctgctggcggcgctgctgtcgcccggctggttcgcctggctgctggcctggctcagcgtggccgcctacggcctgctgttcgagtggcatctggattggccgctgaacggcggcaacgccgcctatgccttcaatttgcacctgtccgggatgtggctgactttcgcattgtcggcgctgctgatctgcggcttcgtctcccggctggcgcgccagctgcgcaagcgcgacagcgcgctggccgaggcgcgggaaacccagctgcgcgacgagcagctgctggcggtgggcatgcaggcggccggcgccgcccattcgctgtccaccccgctcaacaccctgaccttgctggtggacgagctgatcagcgagcgggcgcaggacgaggcgctgagccaggacctgcgcctgatgcgcgcgcagctgaccagctgcagcgccacgctggcgcgcctcaagcatggctccgagccgcagtcggggccgcggccgctgttcgcggcgctggcggagcggctggaaggctggcgcagcctgcggccggacgtcaggctggaatggcaggcgccgcagggcgaggacccggaggtgtggttggacccggcgttctggccggccttgttcaacttgatcaacaacgcggcggaagcgggcggcggcgaggtggcggtggcggcgcggctgcgcggcggccgtttgtcgctggacatcgtcaaccgccagggctgcctgagcgaggcgcagctggcgcgcgccgggctgacgccgctggattccgccaagccggccggcctgggcctgggcatgatgctcagccacgccacgctggccaggctgggcggcacgctgagcctggacaaccgcgccgagggcggcgtccatgcccgcatcgagctgccgctgaaggagcgggcatgagcgacttcctgctgatagacgacgacgaggccttctgcatggtgctggcgcgctcgctggcgcggcgcggccacgcggtgcagtgcgcccgcgacgccgacgaggcgctgcggctggcggcgcaggggccggcgcgcatcctgctggacctgaacctggccggcgacagcggcctcaggctgctgccggcgctgcgcgcggccagccccggcagcgccatcgtggtgctgaccggctacgccagcatcgccaccgcggtggaggccaccaagctgggcgcggtgcaatacctggccaaaccggccggcgcggcggagatcctggcggcgttcgagcagcaggcggccaatccggaactgtcggtggcgccgcagccgatgtcgctgcgccgggtcacctgggagcacttgcagcgggtgctggcggaaaacgacggcaacatctccgccaccgcgcgcgcgctcaatatgcaccgccgcacgctgcagcggatgctggccaaaaagccggtgaaaagctgagtcaattgccatgacgaatatataaatcgggcaatggccggccatcagaaaatatgattggagccggcgctccaatgcggcgtaacttgcggattccataccgacaacagggggaggcaagatgctgcatggacagatgatggaccagccgttgttgatttccgacctgctcgcgcacgccgagcgcttccatgccgataccgagatcgtatcgcgcacggtggaaggccccattcaccgctacacctaccgcgacgccgcccgccgcgcccgccagctggccaacgcgctgcaggcgctgggcgtgcggggcggcgaccgggtcggcacgctggcctggaacggctaccgccatttcgagatctactacgcggtgtccggcagcggcgccgtctgccataccgtcaacccgcggctgttcgccgagcagatcgcctggatcatcaaccatgccgaagacaaggcgctgctgttcgacctgagcttcctgccgctggtggagcagctggccggccaattgcgcagcgtcgagcatttcgtgctgctggccgaccacgcccacctgccggcggatagcgcgattcccaatctgcaaagctacgaagacctggtgaacagccacagcgacgtctacagctggccgcgtttcgacgaaaacactgcttccagcctgtgctacacctcgggcaccaccggcaaccccaagggcgtgctgtattcgcaccgctccaccgtgttgcacgccttcggcagctcgctgccggacagcttcgacatctcggcgcgcgcggtggtgatgccggtggtgccgatgttccacgccaatgcctggggcctgccctacagctgcgcgatgaacggcagcaagctggtgctgccggggccgaagctggacggcgccagcctgcagcaactgatcgcgacggagggggtgaccaccaccataggcgtgccgacggtgtggatgcagctgttgcagcattgccagcgcgaaaagctgccgctctcgccgctcaagcgcgtgatcgccggcggctcggcggtgccggagagcatggtggagcaactggcggagcacggcgtggaaatgcgccagctgtggggaatgaccgaactgtcgccctgcggcaccacctgcacgcccaagctcaagcacgccgctctggccccggccgaggcgcgcagcctgctgaccaagcagggccggccgatctacggcgtggacatccgcatcgtcgacgacgccggcctgccgctgccgcacgacggcgtctccttcggcaatctgcaggtgcgcggcccctgggtgctgtcgcagtattacaaacgcgaactggacgccaaccacagcgccgacggctggttccacaccggcgacgtggtgacgatagacgccgatggtttcatgcgcatcaccgatcgcaccaaggacgtgatcaagtccggcggcgagtggatcagctccatcgatctggaaaacatcctggtcggccatccggcggtggccgaggcggcggcgatcgcggtgccgcatccgaagtgggacgagcgcccgctgatggtggtgacgctgaagccgggcgcccgggccagccgcgacgagctgctggccttcttcgacggcaagatcgccaagtggtggacgcccaacgacgtggccttcgtcgacgagctgccgcacaccgccaccggcaagctgctgaagatgaaattgcgcgagcaattccgcgaccacgcctggccggaaaaatgaagaatggattatttgctctatttttgtggatttttgtagagcaattgcgctagaatggcggctgcactgagaaccgcaaggttttgaggtgttagcccctcgaaatatcgcgctggccacagccagtccgatgtttcttcctcgtgttgacccctgccgcttagccgcaggggtgtttttttatgccgctgcgcatgtggtattcacatcgactgatcttccgcttgcacctatcataattaaaaccgcatgagctttatcaagcgccgttggcccggcctggtttagcgtatcgacaaggttttccaataaatcattatgaatccgtccggggatggcgatgcccgcctgggccgcgccggcagaaccaaagggaacgacatgaaatcactgcgcagccgtctgatagcgctcaacgccttgctgatggcgttgttcggcctggtcctggtgaccatagttttcacgcagatgcgatcagaaatcctggaggggctggataacgaattcgccgccagcctgaaggggcagagctcggtggtgaccacctggctgggagagaagaaacagcagatcgtcgcccagaccgcggtggccggcgaggccgacgcgctgcgcttcctcaaggtgggcaccaaggccggcggcttcaacgtcaactacgccggctacgccgacggccgcacgctgttctccgacgactgggtggccccggccgactacaaggtggccgaccgcgactggtacaagcaggcccaggccgccggccagcccatcgtcaccgacccctatgtcgacgaggccaccaagaagctgaccgtcaccatcgccgcgccgttcaatcacaacggcgccttcgccggcgtggtcggcggcgacgtgatggtggacgcgctggtgaagtcggtgctgtcgctgaaggtgcgcggcaacggctatgccttcatcgtcgacaagaagggcaccgtcatcgcccacccgcaggccgacctgacgctgaagccgatcaccagcgtagtgccggcgctgagcgccgacaagctggcgcagctggtgcagaacgacaaggcctccgatgtcgacatcggaggcaagagcatgctgatttccgcccaggcgatccccggcaccagctgggtgctggcgctggtggccgaccgcgacgagatcctggcgccgctgcacaccctgctgtacacgataggcgggctgacgctgctggtgttcgcgctgatgatcccgttcgccagcctggtgataggcaagatgctggccggcctcacgcggctgaaggcggcgatggaggacatcgcccgcggccagggcgacctgaccctcaggctgaaggacgacggccaggacgaaatcgccgccaccgcgcgcgcgttcaataccttcgtcgcccagctgggccacctgttccgcggcctgaagggcgacgccgccggcgtggtcggcggcgtgcaggacgccagccagctggtggccgacgtcgcgcaaagctcgcgccacatttccgacgtgtcctcgtccaacgccgccacgctggagcagatcaccgtttccatctcccacatcgccgacagcgcgcgccaggccgatgagctggccagcgccaccggccacaacctggcctccagcgccgacaatatgcagcgcctgtcgtccggcatggaaaacaccgtgcagtcggtgcgcggcctggaagagatgctgtcttcgctggacaagcgctcgcaggaaatctccggcatcaccaacgtgatccgcgatatcgccgaccagaccaatctgctggccttgaacgcggcgatcgaggcggcgcgcgccggagaacagggccgcggcttcgcggtagtggccgacgaagtgcgcaagctggccgagcgcaccgcccaggcgacgctggaaatctccaatatggtgggcgcgatccgcgaggaaaccggccgcgccgtgggcgacgtcaactccacggtgcaggcggtggacgaaggcgtcggcctgacccgcgaggcggtggacaatatcgccgccatccgcgcgtccatgctggaggtggtggccaagatgagcgaaatctccaattccacccaggagcagcacaaggccaccacgctgatcgcgcaaagctcggaagcgatcaacggccacgtgctggaaaacgacgatgtgctgcagaacgtcagcagcaccttgcagggcctggccggcaacgccggcaagatggacgccgagttcaataagttccgcctgtagcgcggctgccgcgtccgccagcgccgccttgccaggcggcgtttttgcgtcgattatccgaacaagttctttgcgggaaaaaccgatgccgcccctgtccgccgataccctgcgcgccgcccgcctgttggccgaaggcgagctcgccgccgccttgcaggccgcgcagcaaggcctgcaggccgaacccgccaacgcgccgctgtggaatttgctgggcgtctgcgccgtccggctggatcagccgcaactggccgagcaatgctggcgccaggcgctgcagcatgacgcggccacgccggacgcgcattacaacctgggctgcctgcaggcggagcgcggccacgcggccgaagccgacgcgcactaccgcgcggagctggcccgcgacgccggccatgcctccagcctgggcaatctgggcacgctgctgctggagcaggggcgggcggcggaagcagaagcctgtttccgccaggcgctggcgctgcggccgcagtcggcgctggcgcactacaacctgggccggctgctgcgccagctggagcgccgcgaggaggccgccgactatctgcggcgcggcctggcgctggagccggacgacgccgaggcgcagcagctgctgggccagctgctggtggagctgggccgcgccgacgaggccgaggcgctgctgcgcgccgcgctgcggcgacagccgaaccatgtggcggcgctgaacaatcttggcctgctgctgatggagcggcggcgctgggccgaggcggaggactgcctgcgccgggcgcatgcgctgcagccggacgcggtgctgggcaatctggcggcgctgctgtcggccaccagccggccggccgaggccgaagccctgctgcgcgccgcgttgctggcagcgcccggtaatgtcgactggctatgcctgttgggagtggcgcagctggagcaagggcgcggcgcggaggcggagcgcgcctggcgcagcggcctcgcgctgtcgccgcggcaccgccggctgcggcaaaacctgggctacttgcaattggcgcgcggcgagtatcaggccggctggcgaaaccacgaggccaggctgcagtccggccactatccgcagccgggttcgccgcgttggcagggcgaggcgctggcgggcaggcatctgctgctggtgttcgagcaaggctacggcgacgccatccagtttttccgctacctgccgctgctgcgccagctcgggccggcccgcctgacgctgatgtgccgcgaggcgctgctgccgctgttcgccgcccagggcctggccgacgcttgcctgcctatccgccgggtgaaccccgactttccgccgcacgactgccatgtgttttcgatgagcctgcccggcctgctgcaggccgagccgctgtcgctgcccagctatctgcgggccgatcccgcgctggccgaggactggggccggcgcctgccgcgcggcgggcgcaggataggcttgctgtggcgcggccatgccgcccatccgttcgaccattgccgttcgctgccggggcctgagcgattggaggcgctgtgccggcgcgacgccgtctggatcagcgtgcagccggaccctaccccggaagagaaggaatgggccggccggcacggcgcgctggagctggggtcggggttgagcgatttcgccgccagcgccgcgctgctgacgcagctggacctgctgatcgcggtggacaccgcgatggcccatctggctggcgcgctgggggtgccgtgccggctgctgctgtcctgcgagcacaccgactggcgctggggcgagcagggagacgccacgccgtggtacccgtcgctgcggctggttcgccagcgccgcggcgaggactgggcggcggccatcgcccggctggacgtcggctaggccgccgccgcgctcatagccatttgcccggattcatcaagccgtccgggtccagcgcccgcttgatgccgcgcatcaattccagcgccagcgggtctttgtagcggaccagccagtccttcttcaattggccgacgccgtgttcggccgccagcgtgccgtccagccggtagacgtggtcgtagacgatggcgttgaccgccggctcgtcgtcgaacagctcggcattgccggggcgggtgtagctgacgttgtaatgcagattgccgtcgccggcgtggccgaaggcgacgatgcgcacgccggggaaggcccgctccagatccgccgcgcagtcgcgcaccagccgcggcagcgccgaggtcggcaccgcgatgtcgtgcttgatgctgggaccgtccttgcgctggctttcagatatctcctcgcgcagcgtccacagcttgcgccgttcggtttcgttttgcgccactacgccgtccagcatgtgctgcgccgacagccatgccaccagcgcgtcgttcagctcggccggatcgccgccgtcggacagctcgatcagcgccagccacggcgcggaaaacggcatcagactgggatggtggcgttgcagcacctgctggcaattggcgtccatcacttcgaaggcggtgaggcggtcgccgaagcggtggcgcagccggttcagccaggctatcgccgtctcgatgtcttctacgccgaccatcgcggtcgcatgggcgctgggcagcggaaacagcttcagcgtggcggcggtgatcaggcccagctggccttcggcgccgatgaacagctgcttcaggtcgaggccggtggtgtccttgcgcaggccttgcaactggtccagcacgcggccgtccggcagcaccacttccagccccagcgccagctcgcgcatggtgccgtagcgcagcaccgccacgccgccggcgttggtggacaggttgccgccgatctggcagctgccctgcgaggccagcgccagcggaaacagccggccggcggcttcggccgcctgctgggcttcttgcagcgtgacgccggcgtccacggtcagcgtgttgttgtcgccgtccagggcgcggatggcgcgcagccggcgcatgcccacgatcagctggcggccgctgccgtccggcgtggccgcgccgcaggtggaggtgttgccgccttgcggcacgatggcgactttgcgcgcgcggcacagcttgaccagctcggcgacttcggcggtggagcccggcagcgccaccgccagcggcgcgccctggtagcggcggcgccagtccagcgtgaacggcgcggtgtcggcggcggcggtcaggatgtattgcgggccgatgatggcggccagttgctgcaggaagtcgttcatgcggattccagaaagctttcgtcgacggcggcgtacagcgcggccggcgcgccgctgacggccgcccagtagcggtcgccgtacgaccagtgccaccactcggacggataattgacgaagccggcgtcgcgcatcgccaggatcagtatgcgccggttggcgcgggcttgcgcgcagaggcccgggctgtcggtgtagcaggcgccgcgggattcctcggcgtcggcgttgaacgggcagcccatgtccagctccgcgccggccgcgtcgatcaaggtcacatccagcgcggcgccggtcgggtggggcgccaccgccggcggcgcgacgtaaaggctggcctcgcgcagcaaggccgcctcgtccagttccggctgcagaccacgcaagcggaccagatgctcgtcgtaggagcggcgctggcgcgctagcggccggtaggcttccttgacgtacaggcgcaggccgtccggcaagcgtccggcggcgtcgcgcagccgttccgccaccgcctgcctggctttcaggaaatgggggctgcggctggagatctggctgcggctccggtccaccgcccagtccggataagcggccaggtcgacgaagggctcggcatggccggccacgggaatgtccagcaaggacggatcggctagcgtcagcattttgtccatcggtttcagaacggtccgtcgctgtcgcgcagcttgtccggcagaccgtcgtggccgccgtccggccgcgctggcgcggcggcccagtgcagcttgccgatggcggcgttgcgcgccgggtggcgcggatagtggacctggttgtcggcgcgggtggcgtcgccgaccaccagtaggcggacggcttgctcggtgttgttgatcacggtgtgggcctggccgtctcctgccttgaagccgaccgaatcgcccggctgcagccggtgcagcgcgccgtccagccataggtcgggctcgccttccagcacgtggatgaattcgtcctcggtgctttcggcatggggccagctggtgcgctggccgggttccagccgctcgtggtggatgcccagccgggcaaagccgaaatggcggcccagcggcgcgccgcgggccaggtcctcctggctgtccggataacggctgggttcggttttttccaattctcgccaatggcggatacaagagggtcggctcatctgggggctctctatttctctgtgtttgtccaatcgccgcggcgcaggtctatcgcctgctggcgccgcgcgccttattccggaatgtccggagacatcagctcgtccggatgctgccagcccggctgggcggcgatgcgggccagccaggcctggacatggggccagtcggcgatggccaggccggtgtcggccagccaccacaggtagccgcagagcgacacgtcggcgatgctgatctggtcgccggccaggtagcggcgctcggccagctcggtttccagcaccgccagatcggcgcgcagccgcgtttccagccaggcttccaccgccggttcgtagtgggcgatcaggcgcgagtagcgcagattgggcagcgacaggcccagccggttggtttcccagttcagccattctcgcacgcgctggcgctcgcccagggcgccgcccagcgcgccgtagctgtcggccagccattgcagtatcgcgttggactggcacagcggcacgccgtcggccaccagcaccggcacttcgccgaagcggctggcggcgcggaaatcttccaggcgttcggcgcgcggctgcgagatgtcgacatggacatagtcgtgcgagatgtcggccagcatcagcgccagccgcaccttgtagctgtggccggagtagcggttgccgtacaggatcagattgctcatggagtgcgctttcaggtgttggtggaagccgcgccgttgcgggagcccagccatgccgcggcgaaggccagcggcacggagaacagcgcgggattggcgtaggggaacagcggtttggcgtggcccagcgccgccacccacaccgccgggccgcagacgatcagcgccagcgacgaagcgatgcccgccgcgccgccccaaaccacgccgcgcgcggtgaggtcttgccagcgcaaggccagcagcagcagcgggaaattggcggaggcggcgatggcgaaggccaggcccatcatcaccgcgatgttcaattgctggaacagcgtggacagaacgatgccgaacaggccgagcgccagcgtggccagtcgcgaaacgcgcagctcccggcgcggctcggcctggccgcgcttcagccataccgcgtacagatcgtggctgacggcgctggcgccggccagcgccaggccggacaccacagccaggatggtggcgaaggcgactgcggccaccagcgcgctggcggtttctccgcccagcaggcgcgccaggtgcagcgcggccatattgccgccgcccagcagtttgccgtcggcgccgtggaagcgcgcgtcgggtcccaccagcatcatcgcgccgtagccgatgacgatgttgagagcgaagaaggcggccaccagccaggtggcgatgccgaccgagcggcgcgcggcgcgcgcgtcggccacggtgaagaagcgcatcagcacatgcggcaggccgagcaggcccaggctcagccccaggcccagcgacagcatctccaccgggtcggccagcgcctggctgggcagaaaggcggccgcgccgcgcagtttctccgcggcgtcgaacagcgccgccgggctgccgccgaagcgcgccagcacgccgccggccagcagcagcgcgcagatgaacagcaggctggccttgctgatctgcacccaggtggtggccagcatgccgcccagcgccacgtagaccatcatcagcgcgcccaccaggccgacggcagcgaggtagggcaggccgaacagcagctcgatcagcttgccggcgccgaccagctgcaccaccaggtagcacagcgtcacggtcagcgagccggcgatgctgaccaggcgcacgccggcgtggtcgaagcgctggctgagcacgccggccacggtatagcggccgcgccggcgcagcggctcggccagcagcagcaacagcagcggccagcccgccagcgtgcccaccgcgtaggccagcgagtcgtagccctggcccagatacatgccggcggcgccgaggaaggccgctgcggacaggtagtcgccggccagcgccaggccgttctgccaggccggcaggtggccgccggcggtatagaaatcattaagggacgcggtgcggcgccgcgcggcggcggtgatggccagcgtcagcaggatcagggcggtgaacagcagctgggcgtggctcatgatgcgtcctcatcgcgcgagccgccgtgcagcgcggcgatcaggcagaacagcaacagcagcgccagcgccagcagaatggaaaccggcaggccggccagccggcaggccagccagccggggcgcgcggccaggatcaggtagtagccgagacaggcggcgatggtgaggaggaccagcagtcgctggcagggtgcgggcttcatgcggcgggcaatcgggcaaagagtcgagtgtagcgcatgtcaggcggatgcggccgcttgccattgcatcagccagcgcgcctcgccggggccgaaatagtccggctcgtggccgacggcggcgaagcccagccgctggtacagcgccgcggccggattggccgggtccaccgtcaggcggatgctgcgcgcgcgcggccgcatggccgccagcgccgcctgcatcaaggccttgccggttccgttgccgcggcaggcgggcagcagcgccagcgacagcagccacagctggtccggctcctgggacggcgcgcccagcgcgtagccgatgggcgcgccgcgttcgtcttcggccagccagaaccagtccggccacaggtccagcgcctggcggaagaaaaagtccgggtagacgtggctgccgaacacggcttgttcgatggcgaagatggcgtcgagatcggcgcggcgggcctggcggagtcgcatggagtgctttcgtgtttttgttggaatgcgcagcctaatggaaggcgtccagccggtaaagtccggctgaggcggcgcaagggttttgatatcattgatcttttactatcgaagggaacgcgtccgcattggttggcgcgaaacagcatgatgaatgtgtctggttttgggggaaagtgccgggttggcagaaagtggccggcgtacgccgcgctggcgctgggcatggcgggccatgccgccgcggcgctggcggcggacgaaccggcgacgccgctgtccgcggagctgaaggataggtacgagcaaatgcaggatgatgtgcccaatcgcgttcccatgcttagcctgacgccggccgcatcgggccgcgccgggcaaatggaggcgttggtgcgccagtgcatgaacgagcagttgcagaaacgcaatgattacagcctggagctgcagcgcgccggggccgcggtcttgctggatatgaaaagaatccgcgaggacaacgccgtcgaagaaagcaggacgatagtggagaacctgcgcgcggccgcgcagcgccatcgttatgacatggacgcggttcccggatgcctggaggacaacctcggcaagctgaaactgagcaaggccgcgaagaaagacttcatgcgcggggtgagcgccggcatggccaaaagccgttatcaggcggaaagaatctggacgctggagttcgccttgatcgaccagatggcggcggccacgcaatatctgaccgcgaacaagaactattggtcgatcgacgacagcggccggatggcgtacgcctctccccaggtgaaggcgcaggcggagtcgatgttggcggtgctgggcaagctgcgcgatcagcaacgcgaactggggcggcaaggcgtggccaacggactggccaatatgagaaaagccggcatgtgaggcggcatgcccgccgggcgcgaagccgcgccgcgcggatagagaccaccgggaggagcctgatcccattaatcaaatctaaatattgagaaagcacactgcgcgctggccagaattgccatggtcatcaaacctgaacatttccggagggttgtcatgagcgagttgtcacgtcgcgagtttctcaagttgtcggccgccggcgtcgccgccggcgccattccgcccgggctggccgcggcgatggcgatccgccccgccgggcgcagcctgtccgcggtcaagcacgtggtggtgttcatgcaggaaaaccgctcgttcgaccactatttcggcatgctgcgcggggtgcgcggcttcggcgaccgcagcgcgctgcagctgcgaaacggcagcagcgtgttccgccagccgcatctgctgtccagcgagtttcccttccacctggacagcagccgcaccaacgcgcaatacctgaccgacctcgaccactcctggaccggcacccacgccgcctggaaccagggcaaatacgatggctgggtggcggccaagaccggcctgaccatgggctacttcaaccgcgccgacattccctaccactacgcgctggccgacgccttcaccatctgcgacggctatttctgttcgcagcaggggccgaccaatcccaaccgcctgtacctgtggagcggcacggtggacgccgccggcaagaacggcggcccggtcaccgacaacagcgagaagggctacagctggaccacctatccggagcggctgcaggcggccggcgtcagctggaaggtgtaccaggtggtcggcgacaatttcgacgacaacgcgctggcctggttcacccagtaccgcaacgccaagcccggcaatccgctgcacgaccgcggcatgagctcggtgcccaaggtcagcggcaattcggtgaaggacctagtggcggccatccgcagcgacgcggtgaacggcacgctgccgcaggtgtcgtggatcgtcgcgccgcaggattattccgaacaccccagcgcgcctccggccgccggcgcctacttggtggaccaggtgctgcaggcgctgaccgccaatccggatgtctgggcctccacggtgatgctgctcaattacgacgagaacgacggcctgttcgaccacgtgccgccgccggtgccgccgtccggcaccgcgggcgaattcgtgtccggcgcgccgatcggcctggggccgcgggtgccgctgctggtgctgtcgccgtggagccgcggcggctacgtctgctcgcaggtgttcgaccacacctcggtgctgcgctttctggaaacctggagcggggtgcaggaacccaatatctcggcctggcgccgccaggtgtgcggcgatctgaccgcggcgctggatttcggcagcagcaataccagcctgccggctttccccgacaccgcggcgctgttgacccaggcgcagcaaagcaagggctggccggcgccgaccgcgccggtgccggggcagatgccgcagccggaggcgggccgccgtccggcgcgcgccttgccctaccagtgcaatgcctacgccagcaccgatgtggccggcggcatggtgtggatacacatgcagaacagcggcagccagggtgcccattacgccatctacgccaaccagtaccggctggacggcccgtggcaatatgacgtggccgccggcggcaacatccaggactacttccatgtgcagacttacggcggcggctggtacgacctgaccctgtacggccccaacggcttcctgcgccgcttcgccggcaatatccacagcgcggccggcgtgctggaggcggtgagcggcgtgtcggtggtgcagggcgtgccgcagctgaccctgcagctgaacaatggcggcaaggtcgcggcgactttccaggtgagcgccaacggctatggcggcggggcgccgcagcaggtcagcgtcaacggcggcggcagccagctgctgagctggaacctatccggcgtgtacggctggtacgacttcaccgtcacctgcagcaacgacaccagtttcattcgccgcctggtcggccatgtggaaaacggcgccgccagcgtcagcggttgagcgcggcggccgggcaataaaaaaacccctgtcatgtcgacaggggtttttccgttggacggacgattactcgacgcgaacctgtacggcttgcaggcctttctggcctttttcaaccacgaaggaaacggtctggccttccttcaggcttttgaaaccatcgctttcgatagctttgaaatgcacgaacaggtcgtcaccgccaccttgaggggtgatgaagccgaagcctttttcatcgttgaaccactttacggtgccggattggcgattagacatgggatatctccaggaaacgggtgttttcagtgcggtatggctcaggtcggcaaaggccggccgatcatgcaccttagcccatcataagcgaattctcgcgtttgtggctgattagtcgctcagcgcggcatcggcaatgccggcctcgtggcgggaagcccctgctttgattggggaattttgcggaaagggtatgccgcggacgtacagtcgctgtacgaaatgccaggccgtctagcctggcgcgcgtggcttggcggcgtgatggatgccggtttgcgccaatgaaaatgccgcccgccggcggcggacggcatctggcggcggcgcttaccacatcaccttgacccggttctcacccagccagtcggacagcgccagcagcagcccgtcgtccagccgcaccccccattccggcggcagcatcaggtcgcctttggcctcgccgttattgtaatgcagccgcaccgggcagccggcgtcctggctcttgaacgggtgcagctcggacttgaggcgggcgacgtccacctgcccggacagctgcagcgccaggctgcgggcgtagcggctgcgcgcttcgcccaggctgtacagcttgtcgacgatgatgcgcaggcggccggcgccggcgaagctgtcctcgctgaccttgccttccaccaccagcaccacgtcttccttcagcttgtcgcggttggtctcgaagctttcggcgaacaggctgacctccagcttggtgctgccgtcgtccagctcgacgaaggccattttgccgcggttgcccaccttgacgcggatgccggtgacgaagccggccagcagctgcggcgacttgttgggtatcagccgcgacagcggcgtcttgatgaaggcgcgcacttctttttcgtaggcggagaacgggtggccggacaggtagaagccgatggccagcttttcctcggccagcttcaccgcgtcgctccacggccgggtggccaccatttccaccgccggcgcgacgtcgtcgccgaacatgtcgaacaggccgccctggttggcgttggcgtgctcctgctccgccgcctccatcgccaggccgacgttggcgaacaacagcgcgcggttgggttcgatggagtcgaaggcgccggcgcggatcagcgcctcgatcacccgcttgttgaccagcttcttgtcggtgcgcttgcagaagtcgaacaggttggcgaacgggccgccggcctcgcgcatcgcgacgatgtggtccaccgccgattcgccgctgcccttcaccgcgcccagcgcgtagcggatttccttgcggctgaccggcacgaagcggtagtggctgtggttgacgtccggcggcaggaacaccaggccgttcttgtggtcggtggcgtcgtcgtagaaaatcttcagctggtcggtgttgtccagttcggttgacatggtcgccgccatgtaggcggcgcagtggtgcgccttcagccaggcggtgtggtaggccaccagcgcgtaggcggcggcgtgcgacttgttgaagccgtagccggcgaatttctccatgtagtcgaagatttcgttggccttggcttccgggatgtcctgcttgccggcgccttcgacgaacatggcgcgctgcgccaccatctcctcgaccttcttcttgcccatcgcgcggcgcagcaagtcggcgccgcccaggctgtagccgccgatcacctgcgccgactgcatcacctgttcctggtacaccatgatgccgtaggtgggcgccagcaccggttccaagagcgggtgcaggtattcgaacttggcgccgtgcatccgctggatgaagtcggggatcaggtccatcgggccggggcggtacaaggccacgaaggcgataatttcctcgaacttgctcggtttggcctccaccagcatctttttcatgccgctggactcgaactggaacacgccggtggtgttggcgctggcgaacaccttgtaggcgtcgcggtcgtccagcggcaggtgggcgacatcgacgtcctcgccgctgacctgtttgatgtacttctgcgccagctcgatgatggtgaggttgcgcaggcccaggaagtcgaacttcaccaggccgatctgctcgacgtcgtccttgtcgaactgggaaaccggagaggcgccttcgccgctggcgatgtagagcgggcagaagtcggtcagcctgcccggcgcgatcagcacgccgccggcgtgcatgccgatgccgcgcgtcaggtcttccagcttcatcgccagttcgatcagctcgccggcgccttcgttttcgatgatctcgccgatttgcgcttccatctccatcgccttggtcagcgacagcggcttgttggcctccagcggaatcagcttggacaggcggtcgcacaggccgaagggcaggtccagcacccggccgacgtcgcggatcaccgatttggacgacatggtgccgaaggtggcgatctggctgaccgcctcctcgccgtatttctgccgggtatattcgatcacccgccagcggttttcctggcagaagtcgacgtcgaagtcgggcatcgacacccgctccggattgaggaagcgctcgaacagcagcgcgtatttcagcggatccaggtcggtgatcgacaggctgtaggccaccaaggagccggcgccggaaccccggcccgggcctaccgggcagccgttggccttgccccactggatgaagtccgccacgatcaggaagtagccggggaagcccatctggatgatggtgtcgcactcgaatttcagccgctcgtcgtactcggggcgcctttcccggcgtactgcctcgtccgggtacagctgcgccagccgcgcctccagcccgcgcttggcctcgtgcaccaggaagtcgtccagcgacatgccgtccggcgtcgggaacagcggcaggtagttcttgcccagcaccacgctgatattgcagcgcttggcgatttccacggtgttggccagcgcttccggaatgtcggcgaaacgcgccagcatttcatcggcgctgagaaagtattggcactcgctgaaggcgcgcggccggcgcttgtcgcccagcgtgtagccttcggcgatgcagacccgcgcttcgtgcgccttgaaatcgtccggatccatgaactggatcgggtgggtggccaccaccggcaggcccatttcgccggccagccacagcgtggcctgcaccacgttttccacctgggcgctgtccacgcgctgcacttccagatagaacgagcccgggaacagtttttcccagtaggcggcgcggcgttgcgcttcttcgcgctgcgccatcgccagcgccatgccgacatcgccgagatgggcgccggacaggcacaagaggttgctgttgtcgccggactccagccaggcgcgcttgatctcggcgcggccacggtactggttgtggctgaaggcctcggtcagcagttcgcacagccggcggtagccctcgcggttcttggcggtgagcagcagccggtacggcttgtcgcggtcttcctcgttttccagccagatgtcggccgagacgatgggcttgatgcccttgttgcggcagctcttgtagaacttgaccatgccgaacaggttcatcaggtcggacatgcccaaggcgggcatgccgtccttgacggcgcgcttcaccgcgtcgtcgaggcggacgacgccgtcggtgatggaaaactccgaatggaggcgaagatggacaaagcggggtgcgttcatcccggcattttaccggctggcgctgtggcaaaccagttgaatcgccgacgccgtgcggctggtgttcggcacgccatgcacattagaatgatggcatcatggtattaatgacggtgcgagaaccagatggagttcaatgtgcagcaattggagcggacgaatctgtatcaactgctggtggggtgcgtgctgccccgtcctatcgcctgggtcagcacccaggacctgaagggcgtttgcaacctggcgccgttttcatttttcaatgtgatgagcatcaacccgccgttgctggggatcagcatactcaagcaggcttcggagcgcgacaaggatacgctggccaatatccgcctgaccggcgagctggtggtcaacatcgtcagccaggcgctggccgaggcgatgaatgtcagctgcggcggctatccggccgatgtcgacgagttcgagctggccagcgtggccaaggtggacagcgtcacggtgaagccgccgggcgtggccgaggcgccggtgcggctggagtgcacgctgcaccagtgcctgaccttcggccacggcaccggcgccggcaatctggtgctggcggaagtgcgccacatccatgtggcggacagggtatggaatgagggcgcgatagacgatgtcgcgctgcaggcggtgggcaagctgggtggcgatcgctacagcctgggtcagccggccttcagcctgacccggccctgagcggttttacagcaccgcctgggtctgcgcggacagcgcgtccagcagcgcgtagcggcgctggtattcggcgcgtttcttgctggcgatatccgccatggccttgcgcgccagcgtcagcgggatgcggaagaagcgcccgccttccatcggctccgcgtccagcgtttcccagaagctgtcgtagtcggcgaagaagttgcggcggtagcgccaggaactgtagatatgctcggccttgccgacagccaggatttcgtcggcgccgatcttgcgcgccagcgccgtcagcgcttccatcgccagccgcttgggaaacaggccatgggcgagcttggtggcgagctgcacgctttcggcgccgtgcggcttggtcgggccttgcagcccgcccaccatcaccaccaagtcttcgccgcgtcgggtcagggtgaaggtgagggtggccagcgccacgcgctcggcattgcacacctgcagcgacatttcgccttccttgtcgaaagtgtgctgctgcgtcagcagcacgtgcagcgcgccgtcgttcttgccggtcagggcggccagcgctaccggctgattggacagcagcaggccgcgcgccggctcgcagaagcgctgctccaacaactggtaatgcgcttgcagcgcctgcagcttgccgcgcgcgttcagcgagcggtacagataggggcggtgcagcttgcaggccaggcgcgggttgcgccgcagataggtcagcagggcctgcgagcggaaggtttccagccagcgcagggtccagggcagcgtcagcatgccgcggaggacgaacttgaagcggttcttgccctcgtcaaagccatctctttgggagaattccccgctagccagcgaccagaacagatccaccgaattgattacagtcatgtggaacctcatccttaaggtcgtaaggataagttaaatccgcatataaatttgttaattgttgtgtagtctagtgtgactgtatgtgacgcctgaccattttgtcatgatagtctgtgcggttttatcccgtggctgcgggaacgcgccggccgcgcctgcccggcgaggcgggttcagcctgccgggggctctttcggccgcatcgagtgcagcgcgcttttctgcatttccagcgtcttgatctgcatcgacagcacgcccagattcatcgtcatccagccttccaccaccttgagttcggccagcttgcggtcgatctcctcttccgacatcggcggcaggaaagcctgcatgccgggcggggtggcttgctgccaaaattggcggaacagggcgaacggatcgttgtcttggctcatggcggtttcctggcaaaaaaaaacgggcaagcgacgcttgcccgttcagtataagcctggatggctcagccgacgatcagcactgggcgtccaccgacgccagcgccaccatgttgacgatgcggcgcaccgaggcgataggcgtgaggatgtgcaccggcttggccatgcccatcaggatcgggccgatggtcacgccgtcggacgccgacacgcgcagcaggttgtagctgatgttggcggcttccacgttcggcatgatcaacaggttggccgagcccttcagcgtggagtccggcagcgcctgctggcggatgctttccaccagcgcggcgtcgccctgcatctcgccgtcgatttccagttccggctgcgcttcgcggatcaggtcgaaggcggcgcgcatcttctgcgccgacggcgtgttcagcgcgccgaagctggagttggacagcagcgcggccttcggctggatgccgaagcgcttgatcgactcggacgccatcttggtgatggaggccagctgttccgcgctcggctcggcgttgacgtaggtgtcggtgatgaagatgttgccggtcggcaggatcagcgcgttcatcgcgccggccaccttgtcttcgttggcgtagccgagcacgttctccagaatgtcgaagtgctggcggtacgggccgtaggtgccgcagatcagcgcgtcggcgtcgccgcggcgcaccatcatcgcgccgatcagcgtggtgttgccgatcacgcggcggcgcgcctgctcctgcgacacgcccttgcgcttcgtcagctggtagtagtctttccagtactcggtgaagcgcgggtcggattcgttgttgaccagctcgaagtcgacgcccgggcgcatcttcaggcccagtttctcgatgcgcttctcgatcacgctggggcggcccaccaggatcggcttggccaggccttgggtgacgatctcctgggtggcgtgcagcacgcgctcgtcttcgccctcggtcaggaccacgcgcttcgggtctttcttggcctgggagaacaccggcttcatgaacaggttggtcttgtagacgaactgcgccagctggtcggcgtaggcgtcgaagtcctggatcgggcgggtggcgacgccggactccatcgcggccttggccacggccggggcgatcttgacgatcaggcgcgggtcgaacggcttcggaatcacgtattccgggccgaaggacagctcctggtcgccgtaggcggtggcgaccacgtcgttctgttcggccatcgccaggtcggcgatcgcgcgcacggtggccagcttcatctcttcattgatggtggtggcgcccacgtccagcgcgccgcggaagatgaaggggaagcacaacacgttgttgacctggttcgggaagtccgaacggccggtgccgatgatggcgtccggacgcacttccttcaccagcggcggcaggatttccggttccggattggccatcgccaggatcaacgggtcgcgggccatggacttgaccatgtcttgcgacaccaggcgcgggccggacaggcccatgaagatgtcggagccgaccatcgcgtcggccagcttgcgccagccgttgtccttgatggcgtagcgcagcttggactcgtccagcttctcgtcgcggccgacgaagaccacgcccttggagtcgcagatggtgatgttttcgcgcttcacgcccagggccaccagcaggtccaggcaggcgatggcggcggcgccggcgccggaggccaccacgcgcacttcgccgatttccttcttcaccaggcgcaggccgttcaggacggcggcggcggcgacgatggcggtgccgtgctggtcgtcgtggaacaccggaatgcccatgcgctcgcggcacttcttctcgatgtagaagcactccggcgccttgatgtcttccaggttgatgccgccgaaggtcggctccagcgagcagatgatgtccaccagcttgtcagggtccagctcgttgacttcgatgtcgaacacatcgatgccggcgaatttcttgaacagcacgcccttgccttccatcaccggcttgctggccagcgcgccgatgttgcccaggcccagcaccgcggtgccgttggagatcaccgccaccaggttgccgcgggcggtgtacttgtaggcgttgagcgggtcttcgacgatggcgtcgcagggagcggccacgccgggggagtaggccagcgccagatcgcgctgggtggtcagcggcttggtcggcgcgacctggatcttacccggggttgggaactggtgaaattccagcgcgctttggcgcagttgctcgtccattcgcaggctcctgattgagagatgttcttttgttggatgtaagggagatttagcctcgcattataagacttaagccagatgcgggctatgccgtgtcagacaaaaaacgcgatgggcgagcccatcgcgtcggcatgttttctatgctgggatttcaattcatcatgcccagcgcccgcggcagccacagcgagatttccgggatgaatgtgaccgccagcaggaagcccagcatggtcagcagccacggccacaccgccaccgtcaattcggtgatccccatcttggtgatccccgacgccacgtaaaggttcaatcccaccggcgggtggcacatgcccacttccatgttcaccgcgatcaggatgccgaagtgcaccgggttgacccccagcttcaccgccaccgggtacaggatgggcgccatgatcagcacgatggccgacgggtccatgaagttgcccgccgccagcagcaggatgttggtcagcagcaggaaggcgacgacgccgaagccctggctggccatccacgccgccatgctttgcggaatctgctcggaagccatcagaaaggagaacagcaccgcgttggtgatgatgtagagcagcatcgaactcatcgacgcggcgttgaccagcaccttgggcacgtccttcagccccatgtccttgtagacgaacaccgcgatcacgaaggcgtacaccgccgccatcgccgccgcttcggtgggggtgaagatgccggtgtagatgccgcctatcaccagcaccatcagcagcaggccccacacgcagtcgcggaaggcttcccagcgctccttccagctggcgcgcggcaggcgcgggtagtcgaacttcttcgcccgataccaggtggtgaggcccaagagcgccgacaggcacaggccgggcagcacgccggccatgaacagctggccgaccgaggcggtggacacgctcatgccgttggggccggtgacgtccatgccggcggtggcgatgctgaacatcaccaggttgatcgacggcgggaacaggatgcccagcgcgccggaggtggtgatgacgccggcgccgaagcgggccgggtagccctgtttcagcatcgccggcaggatgatcgagccgaccgccaccacggtggctaccgaagagccggtgatggcggcgaacagcgcgcaagacaccacgccggcgaggccgaggccgccgtaccagtggccgaccagggtggtggcgaagcgtatcatccgccgcgccacgcccccgtgcatcaggaaattgccggccaggatgaagaacgggatcgccatgatctcgaacttctcgatgccggtgaacagcttcagcgcgacggaggtgatcggcacctcggtcatcgtgaacaaaaaggtgagtacggtcaggcccagcgagatggagatcggcatgccggtcagcatcagcgccatcaacaggccgaagatgatcagcgcgctcatggccggcctccttgcttgtcatgcgggtgaagattgtccagcgccgggtcgccttcgatgccgtcgacgtggccgtggtcgtgtttgggcagcgcgccggtcttgacgaagttccaggccacttgcaggaagcggaagcacatcaggctggagccggcgggaatggccagatagaccagccacatcggcgcttccaggtcgggcgaggtctggtcggtgtggccgatctcccagacgaaattgccgcccatcacggccacggtgccggtgaacagcgcgccggccaacaggccgaacacgatgaagcggccgcgggtcttgtccggcaggcggttgatcagcacgtcgacgccgacgtggatgccggtgcgcacgccgtaggcggcgccgaacttggccatccagacgaacaggtagacggtgagttcctgcgcccacgacaggttgatgtgggcgaggtagggttgcagggtgggaatgcccgagccgtagcggtgcagcaccgctacgaacgtgatcagggtggcggcccccatcagacaggcgatcatccactcctcgaggtggtcgaggaacttgagcatgacgatgtttcctaagtgcgggaaaacggccggacggcaagccgtccggccatggcgctgggcgcgcgggcttgcttacttgttggggttgaagccggtttctttatagatctgcttgagcaggtccgggccgatgcgggccgccatcttctggtgcaccggcgccagcgccttcttgaacgcttcgcgctcttgcggggtggggacgtaaaccttggtcttgccggacgccttgatcgcggcgacggctttttcgttttcctgtttggcgatctgattggcgtagacggtagcgtcctgcaccgcactgtccagctggccgcgcacgtcggccggcaggccgtcccagaacttcttgttgacgatcagcgcgtagccgaggaagccgtgctgggtcagcgtcaggttcttctgcacctcgtaggccttgctggtgtagaggttggaggcttccagctcggtgccgtccaccacgccggtctgcagcgcctggtatacctcggagaaagccatcacctgcggcagcgcgcccagcgtgcgcatttcttcctcaagaaccttggacgactggatgcggatcttcatgcctttcaggtcggccggggatttgatcggcttgttggcggagaaattcttgaagccgttgtcccagtaggctaggcccttgatgcctttgctctccaacttgcccaagagctgcttgccgatcgggccgtgcatcaccttgttgacttcgtcgtagctgtcgaacaggtagggcaggtcgaacacttcgaattccttcacgcccagcgggccgaacttggccaggctgggagccagcatctgcaccgcgcccagctgcagcgcttccagctcttccttgtccttgtacaactggctgttggggtagacctgcaccttcacgcggccgtgggtgcgttgctcggccagtttcttgaagtattcggcggccttgcccttgggggtgtccggcgataccacgtggctgaatttgatgacgatttcgccggcggcctgggcgaaaccggacagggtgaggctggcgcagatggccagcgcggtgtatttgcgtttcatgagagcgtctccaaatagctttgtagctttagttatgtatgcgaaccccggttttgccggtgttattttgcataaagtagaagctctagccccgctctgccattagggaattccagcatgccgtttttcacggcgcgggccggcgggcttgttatcatccggcatcttaaccttgcaatgtgacgcccatgtccgcacccgactcccgcatccgccgcgcgccgcgcctgctgtggctgagcgtcagcctggcgctgatcgcgctgctgctggcgctgtgcagcctcagctacctggtgtaccgcgactggcgcgacgagcagcaggacaatctgatccaggaggtgctgtggctggagcaatcgctgcgcatgcatctggaaggccaccaggaatgggctgacggcctggcgcgggacatcgccgccggcaaggtggacagccagcgcttcgcccatctggccgcgttctacatgcgggaaaatcccgaactgctgacgatagagcgggtgggcgcgagcaaccaggtgcaatgggaccagcacggcatccgccgcgaccgccgcagcctggggccggccgagttcgacggcctgtggcgtgcgtcgcggctgctgcgctccagctacggcgcaccttaccagggcgccgacggcaaataccggttcgacctggcggtgccggtggtgcgcgacggccagctgctgggcgggctgcgtttctcctatcagttggacgggctgctttaccaccaggtgccgtggtggatcgcctccaagaactacatcagtattctcgatctgggcggcaagacgctggcgcagaaattcgacgccgccgagcggccgggcaatatctcgcaccagaccagcttcgacccgcccggctacggcctctacctgcgcgcggtggcctaccgcagcggcttgggcctgaccctgccggtgctcacctgcgtgatcgtgctgctgttgctgacgctgtggtacgcggtgtggcgcatccgccgccacatgcgcgagcgcgccacggcggagcagaagctggcgcaggaagtgtcgctcaggcaggcgatagaggattcgatgaagagcggcctggtggcgatagggctggaaggcgagatcgtccgcgtcaaccgcgccttctgcgacatgctgggcttcgcgccggaagagctggtgggcagctacccgccgcacccgttctggccggccgatcagcacggcgtgctggccgacgcgatggacgcggtgcgcgacaaccgccaaccggagcagggcttcgagctggcgctgatgcgcaagcgcggcgacacgctggtggtgcggctgttcgccacgccgctggtgcgggaggacggcagccagcacggctggatcgcctcgatgttcgacatcaccgaacgccagcgccagcgcaaggaaatggacgctgcccaccgccgcttcctcaccgtgctgaacggcctggccgccggcgtctgcgtggtggcggaaagcagcggccagctgctgtacgccaaccccggcttcgccgaactatggctggtgggcgacgccgacgcgccgtgctgcgtgctgctgcccggcctgagggccggcccggaaaacgaggagtacggccaggaattcatcgtcgccggcgaatgctgcctgctgatccgccgtcgccgcatcgaatgggtgaacggcgaagcggcctggctggcgatactcagcgacgtgtccgaagaccgccgccgcgaggcgcgcgaacaggcgcagcaagaccgtttccagaacaccgcccggctgatcgcgatgggcgaaatggcctcgacgctggcgcacgagctgaaccagccgctcaccgccatccacacttacgccgccggcgtcagccgccgcctgccggaacagctggagctgccggccggcgtgcgcgacgccatccatgccatcgccgaacaatcgcggcgggcggcgcaaatcgtcagcagcattcgcgccttcgtcaaaaagcacgagccgcaactggagcgggtggacccggcgcgggcggtggcgcgggcgctgagcctggccgaaccgctggcggccaagcacggcgtcagcctgcagctggagccggaccgccgcgcctgcctgctggacatggacccggtgctgatcgagcaggtgttgctcaacctgatgaaaaacgcggtggaagcgctggtggaagccgacaccccgcagccgtcggtgcagctgcatacctgcgtgggcgaaggcaaatggcgggtggaggtggtggacaacggccccggtctcgccgccggcatgcaggacaacctgttcacgccgttctactccaccaagccggaagggatgggcataggcctcaacatctgccgttccatcgtggaattccaccgcggcgaattcggcgcggtcagcagcccggccggcggctgcgtgttctggttcacgctgccgctggcgggcagggtggttgaatgaaaatgccattgtgctatcatggcgcaatgggccgatagctcagctgggagagcgctgcgttcgcaatgcagaggtcgggagttcgatcctccttcggtccaccagaagtcttatctcaggtatggcagtttgtgacgggaagcataagttggccgaaacggccagcttatacttcccgtttcgcgtttctagccactccgccgtccaaaattcattccgcttttctccatccctattccttggaagtattgcgcagcaaggctttccgcgtttgaaacgccgttccagctcctggccagcttatggttccttgttgaattgattcatgttcaatggggctgttgctgattgatctgagcacggcccttcgtagttgttgcacagttcacgtgtaagggggcaactagccagttgcctagagccacgccgtagaagcgggactgcctccgcgacttgatcggttcgagaggggggactccaatagaagactcgacttgccgacaacagggggcaatcttgctgtgaggtggactgtccacgaggagcgggacagaccaaaaccacttagagccgctaacaaaaccccttgatgccagataggcacgaccacatctagcgaggatgaaacggaaagtcgtcagtcagaagctccggaagtctttgcagccgctactttctccaccaccgcgctcccgccggggtgggcgtccgaggctggatgattttgctgtcgtcagcggcatcttgtttgttctcaccaccggcattccttgggaggatctcccgtaggaactcggttttggcagtggaatgacttaattggagaaggctgcgggattggcaagcgctaggcgtttgggatcgtctacatctagccctgctgatacaactgcgccaacacgatcaaattgattggagccgggccagcattgatggggctagcgttgccaaccaccggggggcaagagaccggccccaaccccaccgatcgaggtaaatgcggcagcaaacggcacatcatcgcagatcgccgaggtttgccactggcgctgagcattaccggcgccaaccggcatgattccatggtcttcgaaactttgcttgatgcgatgcctgaggttcctggtttgccgggacggcccagacaaaagccctgcaagttgcaagctgataaaggctacgactaccgccgtcgccgtgaacacctgagccgacgcggaattttggtgcgaattgctcgtcgcggggtgggaagcagcgagagattgggccgctaccgttgggtggtggaacgcctccattcttggctagctggctcaagctggctttctcattgatctgcatgcgatttatcgacaggttttgttggcgggtctaagcgaaaaaaagcccgcgcttgagcgcgggccaatgacgaaaggggctaggtcagcggatcagtaatccagctccgccggagccttggccttgctgtcctgtgccgcttcggccacggtggcgtcggtggtcaggatcaggctggcgatggacgcggcgttttgcagcgcggtgcgggtcaccttggtcgggtcgatcacgcccatttccaccaggtcgccgaactggccgctggcggcgttgtagccgtggctgcccttgccttccagcaccttgttgacgatgacggacggctcgtcgccggcgttggcggcgatggcgcgcagcggcgcttccagcgcgcgcagcacgatctggatgccggcgtcctggtcggcgttgtcgcctttcagctcgccgatgtgggcgcgggcgcgcagcagggccacgccgccgccggcgacgatgccttcctccaccgcggcgcgggtggcgtgcagcgcgtcgtcgacgcggtctttcttctctttcatttccacttcggtggccgcgccgatgcggatcaccgccacgccgccggacagcttggccacccgttcctgcagcttctcgcggtcatagtcgctggtggcggcatcgatctgcgcccggatggtttgcacgcgggcgtcgatcttcgccttgtcgccggcgccgtcgatgacggtggtgttttccttgccgatttccacgcgcttggcgctgcccagctcggccaggccggctttttccagcgtcaggccggtttcctcggaaatgacagtgccgccagtcaggatggcgatgtcttccagcatggccttgcggcggtcgccgaagcctggggctttgaccgcggccaccttgaggatgccgcgcatgctgttcaccaccagggtggccagcgcttcgccttccacgtcttcggcgacgatcagcagcggcttgccggccttggccacttgctccagcaccggcaagaggtcgcggatattgctgatcttcttgtcgtagagcagcaccagcgggtcttccagcacagcggtctgtttttccggatcggtgatgaagtagggcgacaggtagccgcggtcgaactgcatgccctcaaccacggccagctcgttgtccagcgacttgccgtcctcgacggtgatcacgccttccttgcccactttgtccatggcgtcggcgatgatcttgccgatggcttcgtcggagttggccgacagcgcggccacctgggcggtttccttgctgttggtcaccggcttggacagggtttgcagctccttcaccacggcatggacggctttgtcgatgccgcgcttcaggtccatcggattcatgccggaggcgacgtacttcatgccttcctgcacgatggcctgggccagcacggtggcggtggtggtgccgtcgcccgccacgtcggcggtcttggacgccacttccttcaccatctgtgcgcccatgttttcgaacgggtctttgagctcgatttccttggcgacggacacgccgtccttggtgatgtgcggcgcgccgaaactgcgcgccagcagcacgttgcggcctttcggccccagggtgactttcaccgcattggccagcacgttgacgccgttgacgatgcgttcacgggcgttgtcgtggaagcggacttctttcgcagccatggtttaactcctgtgatgaatggggaaaatcaagcagccttgcggccggattcggatgcgccttcgatcacgccgaagacatcctcttcgcgcagcaccaggtattcctggtcgtccagcttgacggtctggccgccatatttgccgaacaagaccaagtcgcctacctgcacttgcatcggcagcaaggtgccgtcaggcaagcgtttgccgggaccggccgcgaggacttcgccttgttcgggtttttccgcggcgctatcgggaatgacgatgccggaagcagtctggcggaccttttcgacccgcttgacgataatccggtcgtgcagaggacggatttgcatatcaatctcctgtgcgattcagatcatgggaaacggtaggtaagaccggcttgccgcaggcgcgaagatgcccgcgcttgccggtcaaattcagcctgatgggctgacgaatgacgaaataagggcgggccaaaaacttttcaagaggtttttttcagaaaaaatgcggctaaaaaatgacgcgctcgatgcggccgaaacggtattcggttcgggccgccttgccgccgcggcagacgcgcggcgccagcgggcaagggggctggcgtaagccatcttcgcccagcgtgtcgtcctcggccaattcgcgccacagcccgccatgcaccggccggaactgccagcaaacatagccgcggcgcgccgccagccgcatcagctccgggccgtcgggcgcctcggctacgacgctttcctggccgtcgatggcaggcaagtcgccaaaagcctggcggcaggcaagctcctcgccggcggcggcgcccatggtgttgcagccgcgccgctcatcgcgcagcaggctccaggcgcccagctgccaggccgcgtccagaatctcctcctccacccgcgacagcgcgctccatctgcgcgtcagctgcaaggccgacgccggcacttgccgcagcgaggcttggccagccggcgcgcggtcggcggcggctttgccgaagccatgccaatgcagcatcagcagcagcggggtatcggggcaggggacggcgctgaggctgaccgcgaacagcggcaggcgcatatggcggatctgggcggacaaggtatcgaacaattccatggcgacactccatgacgatggatgcgaagacatgcttaaacgataaaaacattgccggcgcgaggcaagggcatgcctcgccgccatggccaggctttcatttccacccctgcagccattggtccgcgtcgcgcagcgcctgccacgccatggtttgccggcgccgggtgtagaccgcctccagcgtcaccgtctccaccgcggcatccggcgccggccggcccagcgccaccaccagaaagtgcttttccttgtcgcgcggcgcggcggcggtccacttgctgagcagcaatttttccggattgagccgtctagttgccgccacggtcctgcctcacccagatcagcttgtcggccggcacgcctagcttggctgccaccgccagcagcgccggcttggcggcgggggcggcttgtttatcgcgcgacagcagccacagataatccttgtccggccccaccaccaccgcccagcggtagccggggtccagcgccgccacatggtagccgccgtagaacggtccgaagaacgacactttcagtgaggcgacatcggcgggcccgttgaaccaggctttgcccaccgcttcgcgccagctggcggtcgcctcgtcaaaaccgcggttgaccacgcggatgctgccgtcggcgttgcggctgtagtcggcgctcaccgcctgcaggccgcgttcgaagcggtgatcgaggcgggcgatttcataccagcggccctggtagcgttccagttggaagccccgcgccggggcgatgccgggcgggggcgcggtgtcacagccggtcagcggcagcaggatcagggcgatgagcgcgagcggttttttcagcatggttgtctcatagtgagtcgagattggtttgcagccagccggcgcgcgcggttatggcggcgcgctcggtttccggcagcttgtccagctggcggtagaccagggccagccgcggattgccggccaactccgcgcggtggcgctggaaaaagtcccagtacaaggcattgaacgggcaggcgtcggcgccgacgcgctgcttgggccggtagcggcagccggcgcagtaatcgcccatgcggccgatataggcggcgctgccggcgtaaggcttgctgcccagcagcccgccgtcggcgaactggctcatgcccagcgtgttgggcagctccacccattcgaaggcgtcgatgtagacgcccagataccattggtgcagcgcttgcggcgacaggccggcgatcaggccgaaattgcctatcaccatcagccgctggatgtggtgggcgtaggcgtcttccagcgattggccgatggcgtgggcgaggcagcgcatgccggtgtcgccgtcccagaaccagcgcggcagcggcagctggtgcgccagcgcgttgctgtcgcggtagccgggcattttggcccaatagacgccgcgcacgtattcgcgccagcccagtatctgccgcgtgaagccttccaccgcggccagcggcgcgcggccctcctgccaggcggacacggcggcgtccactacctcgcgcgggttcagcattttcacattcagggcgaaggacagcagcgaatggaacagccgccgcgcgcgcgggctcatcgcgtcctgataggcgccgaagtgcggcagcccatgttcgacgaaggcgcgcagctgcgccagcgcctcggcgcggttgagcggccagcgcagcgcgtcagcctgcggctggccgaagctggccaccccggcgccgacaatggtttgccacagccggctgtggtcatgctcgggacgcgcatcgcctggttcgggcggatcgccgggccagcgctggcggttgtcggcgtcgaaattccagcgtccgccggcgggctcggcgttttcgtccatcaaaatgccgtgctggcgccgcaggtggcgatatagggtctcctgccgccattgccgcccgccgaacaacgccgccacctcgccgcgcgcggtgtagaagtgctcgctgtccgccatgcggcagggcatgggcaggccggccgcccactccgccagctggcggtccagccgccactcgtccggggcctggtactccaccgccgccgcgcggtaatgggcgatcagcgcgtccagattgccggtcagcgactggcggttgctggcgtcgttgatcgcgacgtagcgcacgcggtggccttgcgctttcaattgggcggcgaagtcgcgcatcgccgcgaagatggccaggattttttgcgcgtggtggcgcacgtagtcggtttcctggcggatttccatcatcacgtgcaccacattggcgtcgggctcggcgaaccagctgtggcagggattgagctgatcgcccaggagcagccgcaaggtggtcatgcggctttgcctttctggcggcggcagcgctccgagcaatactgcacggcatcccagctggcgcgccatttcttgcgccagctcatggcccggccgcagccggcgcagggcttggacggcagcgccgccttgttgcccttgaaggtccgcgccgccatcacaccaccttgagtttcttgcgcagccaggccaccggcaggcccagcaccggtattttctcgaacagttcttccgccgcgtcccagtagtcgcggtgcagcgcgatcttgccgccggcgtcgaactgcagatggctgccgccgtggatattgaccttgcgtccagcgtagacaaagtcgaaatcccaggtgatgaaagcctggtcgccgtcgcgcagcgcgtggatgacggtgaagcgcggttgctccagcgtcttgaacatgtggcggaacaccgcctggatgtcggtgatgccgcgcgcgtcgttgaacgggtccttgaagcgggcgtcttcagcgtagaagtggccgatatcgggcaaggtgtccggcgtcaacgtctggtaccagtcaagcaaagcctgccagtcggcttgggaggggatgcgtttcatggtcgagccagcctcgcgagcaagggcagccgcagccggtaaggcagcagccgcaacagtttgagccatgcggtgaagcgcagcgggaagtggatttcaaacgcgccgcgcgaaagaccgcgcatgatgctttgcgccgcttggcgcggggtgagcagcgccggcatggaaaaatcgttcttggcggtgagcggggtggcgacgaagccgggattgatcagataaaccgccaccccgcgcggcttgagctcggtatagaggatttccgccagattgatcagcgccgccttgccggggccgtacaccgccgcgcccggcaagccggcgtagccggccacgctggcaatcagcgccacgccgccgcgcccttcccgcgccagcgccggcagtaccacttccagcccgtggtagacccccagcagattggtgtcgagcaggcggcgggtttcgtctgcatgcaggtccagacaggtctgcggacggtaatcggccgcgcagaacactaccaggtcgggccgcgcgccgtttcgctccagccgctcccagacgcgcgaccaggccgccggatcggtcacatccagcgtttccacgcgcgcgccggcgcggccggcggccagcgcctgcatcggctcggcgcggcgcgccgacaggatgacctcggcgccggcgtccagcagttcggtagccagcgcggcgccgatgccgctggacgcgccgatcacccagacgcggcgcgcatgccagtcggcgatggcgggattgaggcgcaggctcacggccgcggctccggcttgcggaaaaacagcgtgacttcgcccaggcggaaaccgaacttgctcatctcggcgcggttgagcaggctgcgctcgtcctgcaggaacatccagtcgtcgaactgcacctggtattccttgccgtccaccggcagcttcagcgtgtagcgccagcgcagcgcgttgccggcagtctcgcccgcggcctcgcccaccacatcgtcggccaggccgcgccagcgtcctgcgcccagcggcttgagccgccacacgcgctgctggcggctgccgtcgctgtagcggaagcgctcggtcaacaccaactcgtctccctggcgctcgccgtccatgtccacggtaaaacgcttcagcagtcggccctgtctatcctggaacatgccccaggcctcggttttgccgaggaaaaaccggccggggtccagcgcgggacggttggcggcgtaatcggccgccgacggtccggcgcaacccgtcagcaaggccagcaaggaggcgagagcggcgcgcggcatcacgcatgcctttgcagcagaaattgcgaaacgccgatgcggccttcgtcgaaaccggcttcgcagtagcacagatacagccgccacagccggatgaaggcctcatcgaagccctggctgcggatggcggcgagattggcctcgaaagcatcgcgccagcggcgcagggtttccgcgtagtcggggccgaaatccagccggccgcggcaggccaggccgccttgccgcgccgcgcgcaagaagcgttcgcggctgggcagcatgccgccgggaaagatgaaggtctggatgaaatcggcgttggcgcggtatgtttcgaagcgcgactcttctatggtgatgctctgagccagcgcctggccgcccggcttcaggcagcggcgcagggtgtcgaaatagccgcgccagtagcgctcgcccaccgcctcgaacatttcgatcgacacgatggcgtcgtactggccggagaggtcgcggtagtcgcggtgctccagtatggccagcggctcgttggccaggcggcggcgcgcgaagtccagctgcgcgtcggagatggtgatgccgtgcacggccacgcccaagcgggcggcatgctcggcgaagccgccccagccgcagccgatttccaacacccgcatgccggggcgcagttgcaattgatcgcagatgcgctggtacttgcgcgcctgggcatcggccagggacaagcggtagtcgccgtcgaaccaggcgctggagtaggtccagccggggtccagccacagctggtaaaaatcgttgccgatatcgtaatgggcatggatgttgcgccggctgccgcggcggctgttgacgcgcaagaggtggcgcagcctgtgccacgcgcgcgcggcccagcggcccaattcgcccagctgcatcgcgtcttcgttgcgcagcgccagccgcaacagcgcggtcaggtcggggctgtccagccagccgtcgcggtatgcctcggcaaagcctatgtcgttgccggacagcatgcggcggcaggcgcgccagtcggctagcgtcagctcggcgtcggcctgcggcttgagcgcgccgtaccacagctcttcgccatctggcgtgacgattttgaggctgccgtgtcgcagtttcgacaacaaggccagcagcgcccgcccggcggcgggaatgtcagggcgggacagggcgatgggttggcttgcgctcatggtttcaactcctggccgcggctgagcgcggcggcggggggatgaggtttgcggaaaaagggcacgcgtttgagccacagccgcagcgcctgccagtggatgcgggcgatgacgcccagagtcagcagcggctggcgcagcagggcgcgcgcggcggttcccggcgtcagcggcgacaggcggccggagatggcggtgtgcagcagcggcccggcgtcgttgtggtagtcgatgcggaccagcgcatggtctccgctttgatggaagcggaagcggtaatggccttcgatgcggcaaaacggcgagacatgcagcagtttgcggcatgagagctggctggcggcggagatggggccgccgccggtctggctcaacagatagccatgcctttcgccaaaggtattgttcacctcggccagcaccgcgatcagttgaccggaggcgttgtggcaatgccagaagctgaccgggttgaacacatagccgaacacgcgcggaaaggtttgcagccagacctcgccgttggcgggcaggccggcttcctccagccgcgcgcgtatccacggcaagagcggcgagccgtcgcgcgggccgtagtcgcgcgtgcgcagcgacagcggccgccagcggtccacgccaaaccagaagccgcgcaggctttcgagcttggccagattcagccgcaagcagaaaaccggatagacgaagcgattgggcgccggccgcaagcggcggtgcatcacctgcccggtcaacagataggcgccgctcatttctccaacctcgcccaggccggagccagcccaaaatcccgcgccacgcgcagcgcggagttcagcccatcctcgtggaagccgtagccggtccaggctccggcgaaccagcagccgtggcggccctgaaggccggacaaagccttttgcgcggcgatggcggcggcgtcaaacagcggatgctggtaatggtagcggcccagcaccttggccggatcgggggcgcgcggcgggttcaacgtgactgccaccggcgtggcgacaggcaggggctgcagttggttgagcagatagctgacgcccaccgcgcggctgtcgtcatcgtcgtccgacaggaaattccaggctgaccaggccgcttcgcggcggggcagcaaagaggcatcggtatgcagcaccgcctcattggcttgatagcggacggcggacagcatcttgcgctccaaatcatcggcatccgccagcatggccagggtttgcggcgcatgggtagcgaagacgacgctgtcgaaagtctcttcgctgctggcggcaagcaagcgcacgcggccatctacccggctgacgcgcagcaccggcgtcgacagccggacatcggccaggctggcggcgattttctcgacatactgccgggcgccgcccggcaccgtgcgccattgcggccggtcgcgcagctgcagcaggccatggttcaggcagaagcgcaggaaagtctcggccgggaaggacaggatgtcgcggcaggggctggaccagatcgccgccgccatcggcagcaggtagtggtggcgaaagcgcgcgccgtatccgtccgcgtccagcaagcgccccaggctttgcggggcctcgatcgcgcggcgcagattgcgctccgcctcgcggttgaagcgcaggatgtcggacagcatgccccagaagccgggcgacagcagattgcggcgctggacgaacacgctgtccagatcgcgccccgcccactccagccggccctggcccagcgagacgctgaacgacatgtcgctgggatggctggggatgcctagctcctgaaacaaggcgatgaggttgggataggtgcgatcgttgaataccaggaagccggtatcgacggcgaagtcgcggccgtcgaccgtgacatcgacggtgtgggtatggccgcccagataatcggcggcttcgaacagcgtcaccgcgtgccgtcgggaaagaaagtaagccgtggcaaggccggcgatgccgccgcctatcacggcgatgcgttgtggcgatgaggcgttcaccatgtcgtcctgtcgcgaggtaggaaatccgccggttggcagtgcgccggcgctgctttatattcaggataaaaccaatttgaaaaaaatgctactgatcagtaaaaggtgttaccgatgggtatactaggcaggctcagcttcaaggatcaggctttcaagctgcgcgagcaggcggtgctcgacgccaccacgcggatgctggcgagcaagggtttcgacctgatgaccatggacgatgtggccggcgaggcggggatttccaagcccagcctgtacaagcatttcaaatccaaggatgagctggcgaccgaggtgatgatccgcttgctggacgacgcccaggattttctggcgcggcaggcgccggagttgagcccgcttgcccgcctgcgcgatctgctggcttgggcgctgggcatgcgcctcgccggcgggctgccgttcctgccctcgaccagtccgcaggtgcgcgccatgctgacgcgcagcctgcgttacgtcagccgggcgatcaagctgcacaaaatgctgcagggcatcgtcgagcaggccaagcggcagggagagctaagggcggatatgccgactgacgtgatcctgtacagctactactcccggacctgcgatccggcggtggagtacttgcgcgtctatgggaaataccaggacgaagacatcgtcaggcatatgctgcgagtctgtttcgacggcatggcggacgatcatcgccgcgatgacggagagtcgtgaggccgcggatcagagggggcctgcggtgtctgatcggccgccgacatgagtagcagatggttccctattgaagagtgcggtacttgtcagggggactgggtgatacgcggggctgctgttcggccaatgcgggctgtcatcccatgtgtcctgaacgtctgctcagattcacatgccggccatttcgctgtcgccggcatcgaacgtcagctttcttcccctttggggcgcgcaggggcgtgttaccatctgcgccgtgccgtttttattgctttgcggcatgcggcggcgcgccgctgccgctgcaccattgtcatgatgcggccaacgttggccacttttctgtcgtcttcccgccttgtcgccggtcgcggcgtaaccttttttctgccgccgcacggcgcctcccatgatcattctgaaaaacgtggccttgcgccgcggcaccaaagtcctgctcgacaacgcgtcggtgacgctcaatcccggtgagaaagtcggcctggtcggccgcaacggcgccggcaaatcctcgctgttcgcggtgctgaacggctcgctgcacgaagacggcggcgatgtgtcgatcccatcgcagtggcgcatgtcgcaggtggcgcaggacatgccggaaacggcgcagatggcgaccgagtttgtggtcgaaggcgataccaccctgctcgccgcgcagcaggaggtggccgaggccgaggccggcgaagactacatgcgcatggcgcacgcctataccgcgctcaacgatgccggcgcccacgacgcgccggcacgggcgcaggcgctgattctcgggttgggtttcagcgtcgccgagctgcagcagccggtgaacagcttttccggcggctggcgcatgcggctgcaactggcgcgcgcgctgatgtgtccgtccgacctgctgctgctggacgagccgaccaaccacctggatctggacgcgctggtatggctggaagcgtggttgaagcagtacgccggcaccatggtggtgatcagccatgaccgcgaattcctcgatgccgtcaccaacgtgacgctacacgtcgacaatgccaagctggtgcgctacggcggcaattacagcaagttcgaggacatgcgcgccgaacagctggtcctgcagcaggcggcgcaggccaagcagcaggaaaagatggcgcacctgcagaagttcatcgatcgcttcaaggccaaggccagcaaggccaagcaggcgcagagccgtgtcaaggcgctggagcggatggagaagatcgcgccggtgctggccgatgccgagttccagttcgaattcaaagagccgcagagcctgccgaactcgatgctgtcgatgaccggcgcggcgttcggctatccggcgccggagggcgcgccggaaggcacgccgccgacggtgatcgtgcgcaacgtgaaccgcaccgtgctggccgggcagcgcatcggcattctcggcgccaacggccagggcaagtcgacgctggtgaaaaccgtggccgaggcgctgcaggcggtcggcggcgagatcattcgcggcaaggggctcaatatcggctacttctcgcagcaggagctggacgtgctgcggccggaggacgatccgctgcagcacatgttccgtctggcgcgcgacaccccggcggcgatgcggccgccggccaacgattgccgcgagcaggggctgcgcaatttcctgggcactttcaacttcagcggcgacatggtgaagcagccggtcggcagcatgagcggcggcgagaaggcgcggctggtgctgtgcatgatcgtgtggcagcggcccaacctgctgctgctggatgaaccgaccaaccatctggacctcgccacccgcgaggcgctgagcgtggcgctgaacgagttcgaaggctcggtgatgctggtcagccacgaccgggcgttgctgcgcgcggtgtgcgatgaattctggatggtgtcgcgcggcggggtcagcgatttttcgggcgatctggacgattaccaggtctacctgctggaagaggccaagcgccggcgagaagaggcggccggcaagcgttgagccggcccgtccgcgcgtggccaccttgcggccaagcatagggaggtgccggggcagcccaatgatagcttccaacccactgctactggctgaacagcagtcctggtctgccctggctggcgctcattgagccagcggcggcgtgcgcggcgggatcatgcgcttgttgccggtggcttcaaaggcgccggcgaagcgcagcagcgcgttgtcatcataggcgcgcccggcgaaagtcagccccacaggcatgccgatatccgccatcacccccatcggcacggtaaccgtggggacgccaagatggcggatggcgaggttgccattggctacccagatgccattgctccaggcgatgtcggcggagcgcggattgacgtccgcatcagccgggccgacgtcggccacggtggggaacagcaccgcgtccagcttcagcgcatccatccagtcttccagatccagcttgcgggtcttttccagaccgcgcagaccatccggcacgcttgcaatctggtcatagggcttgaggccccgcttggccatgttgacgtattcgtccatgcctgcggccagatccccttcccggttgggcaaggtgccaggatcgtgcgggaagatcttcggaccatccacgtcggccagtttgttgagcttggggtcgccgttggcgcgcaggaactcgtcgaaagcccagccggacagctcccacagctcgtcattgaggaactcaggcgagacgatgccgcggttgaatacggtgggcgcgccgggacgatcgccttcgcagttggaaaccagcggaaaatccacttcgatgacttccgctccggcggcttccagcgcctggcgcgcggcttcccagaggtcgatcaccgacgcgcgggtatggatgcgctggccggtcgggccgccgatgccgggcttctcgctggtgccggcgagctcgtccttgttgatgtacatgcgcggtatgccaaagcgcttgcctttaagcatgtcgggctgggccagcaggccggaataggaatccggccggacctcggaggctttgggaatctttacccagggctgcaggcgccataggtcgccgcggctgatcgggtcgtccgcgacgatgacgtcgagcacttcgagcaagtccgccatggtgcgggcgtagggcacgaccacgtccatggtcggcgtcagcggccagttgccgcgcaccgagatgaccccgcgagacggcgtataggcgcacaggccattgttcgaggccgggccgcggccgctcgaccaggtttcctccgccatgccgaaggcggcgaagctggcggccgtagcggtgccggcgccattggaagagccggaggcgaacggcgccgtcaggtagtcggcgttgtaggggctttcggcgcggccgtagcagccgcgctgcatgccgccgttggccatgggcggcatattggtcttgcccaggcagatggcgccggctgcgcgcaggcgcgcgatggtgaaggcatcgtgttgggccaccagatccttgaacgccgggctgccggaagcggcggtcagccccttcaccagatagctgtccttggcggtgtaggggatgccgtccagcgggctcagcgtttcgccacgggcgcgacgggcatcggatgcctcggcttcctggatcgcatccggattgcgcaccaccaccgcattgagcctggtctccgtcgcggggccatcgtaggccgctatccgcgccagataggccttgaccagttccaccgctgttgtacgcccggattcgagcgccgcgcgcagttcggcaatggatagttcggtaacctcgatcatgctactacctccactcaaaagacggatttcacgcccatcgcggcgaccgtttccggtttgcgcaggcgggtgggcgcgctcaggcgccgcacggcagccggcgcgcgcatgggttgttctgcaatatggcggctaatctacaagagatagcatcatgcgggaaaatgattcattttaatgcactcattcatacggcgaataccggggccgcatcatcggattcgatgagcttgcgcatcaaatcgcgcagccagtgcagcgccggatgactatcctgtactgggtgccagatgcagttgaggtgatagcctggcaactcttccggcaacgccaccatcttcaacggccagtagcccgccatcatcgccgcgactttcttgggcaggataaacaaatgatcggtgttgctgacgatggcggctgcggccatatagctttggctgtgcaccgaaatcttgcgctgcaagccgcgcgcggcaagaaaatcatccattggcgacccccgattgcctagcggcgcgtggaagacatgcggcaaggcgatcagatccgacagtgtcagcctatcgctctggagcgggtggccatggcgcaagatgccgatcagcggctcgttcagccaggtttcccggcacagatagctggggatggacatgtattcgtcaaaacccagcaggaagtcgatttcaccgtcggcaagcgccagttccggaatgtcttcccgcaggatggtgatgtcgatatgaacattgggcgcgacctccgccagttttttcaccagtggcggaatcagcacgcactctacataatcggtggtgcacagggtgaagcggcgcgccgatgtggccgggtcgaaggcctccggctggctgaaatggctttgcagcaggctgagcgcctgatggacgccctgttgcaggtagagcgctttttgcgtcggcagcatgccatgcggcgagcgcaccagcagcgggtcgtcgaagaaggtccgcaagcggttgagcgagtggctcatcgccggctggctgacaaacagtttctctgccgcccgcgtgacgctgcgcaggctgatcagggcatccagcgccagcagcaggttcagatccagttgatgcagcttcacaccattcaccgtatttatgaaagtattcgtattgttcatttgctgaatagtttggcgctacatagactgcgtctgtcaatcacttcgtcgttcatcgcagaggaaatctgccgttccagcaggcggttccgcccggcgaatgtgcattggtcgagccgccgcatcgcgcagatcgggagacgcgccgagtctgtcatccgcaaatgcacgattcattgaatacttctgatggcatttatcaagccgatggtgatcaacatgaacaataaaacgcacaatagtcttccggccgccgatggtttccacatgccggccgagtgggccgagcatcaggcggtatggatgatctggccgcagcgcccggataactggcgccatgccggacgcgaggcgcaacaggtctttgccgccatcgccaaagccatttccgcggccacgcctgtgttcatggccgtgccggaaccgttcatgtcgcaggcgcgcgcagtgatgccggccgaagtcacgctggtggaaatgaatagcgatgactgctggatgcgcgacagcggaccgaccatggtgatcgatcaggcgggccatctgcgcggcgtggactggaagttcaatgcctggggcggcttcaacggcgggctgtaccatccttgggatcaggatagtgaagtggccagccaggtgttggtccatcatggctttgatcgctacgcggctccgctggtgctggagggcggctcgattcatgtcgatggcgaaggcacgctgctcaccaccgcggaatgcctgctcaatcccaatcgcaatccggatttgtcccaagcccagatcgaggctttgctttccgagtatctggacgtgacgcacttcatctggctgccggaaggcgtgttcatggatgaaaccgacggccacatcgacaatatgtgctgctttgcccgtcctggcgaggttgtgctgcactgggtcgacgatgagcaggatccgcagtatccgcgttcgcaggccgcctacgaagtgctgtcccaagcgcgcgacgccaagggccgccagctcaagatccacaagatgctggccccgggccccttgttctacgagcaggatgaaacggctggcgtggtggctagcgggcaggcggtgccgcgtgaggttggcgagcgcatggccgcttcttatgtcaacttcctgatcagcaacggacagatcattttcccgctgctggatgagcgcaccgatgccgcggcggccagccgcttgcaggagatcttcccggagtaccgaattgtcggcgttcctgcgcgcgaggtactgcttggcggcggcaatatccactgcatcacccagcagattccagctggcaaggctggctaaagcgctctcgtaaacggcgggtgaattcccgccgtttctgtttgccatgaaccaagcttgcgcggaatttcgtgcgcggccagcttatggtgccggtcacaggaagcgctgtcgacatgttgatccggccgcgcagaagctggcggcgcggcctgcgcatgcttgccgcttggcatttcttgccgctcctcgtcccaaagacatcccccgtttctctcccatcaccttctagaagcacggcccagcaaggcttttcttgttagatacgccgtcctggcccgagcccggtctcatgcggctaaaccacggactttggccagccgcgggaacagctccagcgcgttgcggtggttgatggcggcatgttccgccgcggacagttcagcgcatgcgtccagcttggcggtgaatgatgccccaacctccgccggcgcgtaggggtagtcgctgccgtacaggatgcggccgacgccggcgaaggcggtcaggctgggcagggccgcggggccggaagagagcgcggtgtcgaaatggaagcgctggaacaggcgcagcaattccgctgtcgccggaacatcatcgcgcacgccctgagccagttcggcgaagcgatgggacgcgtacggcagaaagccgccggcatgggacaggatgacgttcacgtccggatggcgggccagcgtgccgttcagcaccatctgcactgcggtgcgggtggtatcgaagggatagtccaccagcgggccgggcatgccggcgatggcgtcgatggccggtttgccaggatggatgaacacggtggcgcggcgccggttcagttcggcccacaccggctcgaatgccggatcgcccaggtattggccgccgtagttgctgagcagcaccacgccgtccgcttgcagcgtgtcgaacgcgtattcaatctcccgcagcgagccttcgatgtccggcagcggcacggtggcgaagttgccgaagcggtccgggtggcgcgccaccaggccggcggtgtattcattgacgcggcgggccatgtccagcttggcttggccggaccagccctgcacgccaggagcggtcagcgacagcatgccggtggcgatgccctggctgtccatgaaggcgatggcgctttgggggctccattccgggcttttccagccggacgggtcgccgccgtgggcgggcagggcgtcagcccagaatggggggacgacatgctgatggacatcgatgcgttgagtcgcggtcatggtgtggctcctgattcatggcgccgcggcgcggcgtctgatgctcagagtaggcgcgtttgaaaaatcactccaatagattaaatttcaatattgatcattttcagtgatgagtttgagcgcatggaactacgccatttacgctatttcctggcggttgccgacgagggccatttcggccgggccgccgaaaagctgcatatcgtccagccggccttgagcgcccagatccgggcgctggaggacgagctgggcgtcaccctgtttgaccgcagcacgcgcaaggtggagctgtccgacgccgggagaattttgctgatcgaggcgaggcgcacggtggagcaggccgagcgcgccaagaacgtgatgcgccgcgccgcgcgcggcgaaaccggcgtggtgaggataggttttgtcggcaatgccgtggcggcggggcgtttgccagatgatttgctggcattccatgcggcctggccggatgtggcggtggacttgcatgaaatggcgccggcggcgcagttggaagcgcttctggcggggaggctggacgtcggctattgcccgcagctgggccatccgctgcctgccgggctgcaggccaggccagcaggcagctggcattgggaggtggcgatgggcggccagcatcccttggccgcgcgccggacattgcgcgtggacgatttgcgggagcagtcgttcatcgtttacgccgcagacggcgacgacgagggccagttgccgatgttgcgccagctgttgggcgcagaaccccgcatcgcttacaaggtgggcagcaccatgtcggtgctggccttggcggcggcgggcctgggtctggccctggtgcccgcgccggtgcgcaaaatggcggcgccgaatctcgtttatcgccggttggcggagcgctcgccgctggtgtcggaattgtcggcgatcagccgcgcgggcgaggaatggggcgctgcgcggcgctatctggacatgttgaagggctgagcactcgcgtttgggcgcggagcggcaggagagaggcggattttgtttgggatagatcaatttccgctcgctattggcgcggcaagccgctgggcggtccctataacggaagcattgcagattaagcatccgggagcgccaaatgcgatcgacgaatctgttcaagcggctctgggcgctcatggcttgcgccgcctggctgtggtccgcggcggcgtcggccttgccgagttatgcgcggcagaccggcgaggcctgcatcgcctgccacgtcagctttccggaactgacgccgtatggcaggctgtttaagctgtccggctacactttgggcgccgccaagttgtttccgctggcggccatggcccaggcctcgatttcccatgtcggcaacacccagggcaatgacggcgcctatcccaggcagaacgacggggtgatagaaggcggcagcctgtttgtggcgggcaagatcggcgatcatgtcggcatgttctcgcaatggactttcaacgcgttgaaccagaatcccggcgcgcaggacttttccggccacacggtggcggacaacaacgattggcggctaagcgaccacatcgccaacagcgatctggacctgatctacgggctgtcgctcaacaacaatcccacggtgcaggatgcctggaatacgatgccggccttcggctatccctatcaaagcagccacttgaccggagcctggggcattgcgccgccggccacgctgatcgagggcgggctggcgcaacagacggccggcctcagcgcttacgcattcctgaataaagcctggtacttcgagctgggcggataccgcgtggccaagggcggcgcctcgctgttcaaaagcggggtcgccttgagcaaccggctggatggcaccaatccatacgggcgtttcgcctacagccatgattggagggaacactcgatcgaggctggcgttttcggtctggacgcgcgagtccataccgacccttccgatcccggctcgccgaccaaccactaccgcgataccggcctggacgcgcagtatcagtatttgtccgagccgcatgtgttcaccgcgcaagccgcttacatccacgagcggaccgtttgggacgcgtcgcaagtgggaagcgcggtgcaaaatcccggcagccagctgaacgctttccgcatcaagggcagttactggtatcagcgcaggtatggcctgaccttggcgtatttttctgaaaccggttcggccgacaatatcgtctatcccattaccggcagccccaataccaatggctgcatcgccgagctcaactacatgattcagcccaattggcgggtgggcctgcagtacaccggctttctgaagtatcagggcgccagcgccaattacgacggcaatggacgcaacgcccgcaacaacaacgtcacctacctctacacctggatagccttctgacaggggagtgcgatgaaaacgctatggatgataggctggtgcggcgcgttgctgtcggcaggcgtggccctggcggacaaagatccggagtcgctggcgcgcggctggtgcgccaattgccacggcgcggacggcaatagcgtttcgccgctgtttccccgcctggcggggcagcaggccatgtatttgcagcagcagctgcagctgttccgcgagcaaagccgcagcgaccaggcggcgcacgactatatgtggggcgtggccggcggcttgaaaggcgcggaaatcgccggcgtggccggctatttcgccgcgcagacgcccaagcccaatccggcgccgccggcggcggccgctgaactggcggcggggaaggagattttcctgcgcggcaagggcgacagcgtgccggcctgcttcgcctgccatggcgcgcggggcgaaggcagcgaacaggcgccccggctggcgggccagcacgcggcttatctgatcaagcaactgcgggtcttctccacgcgccagcggcccgcggcggcggcgatgcaggccatcgtccatgacctcagcgaagacgatctgcacaatctggccatctacttgcaaagcctgtagcccgcgcgcctggcttacttgcccgcatgcagcaaacaaccgagcggcggtggagctgccgggggcgaatgtccgggcgcgatcggacggccctcctgtcgccgtgcccgccatcgtcacgcggctgcgctttggcgctggatccagcggcgatagcggccggtgcggatcttggcgtcccattgctgctgcaacagcgccaggactggcgcaacgtccggccgggcgcgcttgccctggctgaggcggcgcagctggtatttcaccatcgccatatagccgaccgaggccagcaccttgtttttccagggaatggcgcgcagtctcggcgcggccgtcgcgtcgctgcgccaggcattgggcagattggggtttatcgccagcgcggtggccatgccggccacggcgacgccgctgcccagcacttgctccaccaccgggtagcggcggatgccgccggtcaccatgacgggcatccgcgcgacggcggcgatgtcctgggcgaattccaggaaataggcttcgcgcgccagcgtgcggccgtcgcgcgtctggccgtgcatggccggcgcttcgtagctgccgccggacagctcgatcaggtccacgcccaatgggttcagcatggccgtcacctgtttggcgtcgtcggcgctgaagccgccgcgctggaagtcggccgaattgagcttcaccgacacggcgaagccgggacgcaccgccgcgcgcacttcgcgcacgatgtcggtcagcaggcgggcgcggttttccaggctgccgccccagcggtcggcgcgctggttggtgatcggcgacaaaaactggctgatcaggtagccgtgcgcggcgtggatctgtacgccgttgaagccgaaccgctccgccagccgcgccgtgttgacgaagcgggctttcacgtcggcgatgtcggcctcgctcatcgcgcgcggcgcggcgaactgcttggaaaaattgcccagctccatcgccaccgccgacggcgccagggtgggctggcccagcgcggccggcatctggcgccccgggtggttgatctgcatccagatctgcgcgccgcgggcgcgggcggcggcggaccattgctcaaagcggacgccgaatcgctccgactccagcaccacgccgccggggccggtcatcgcgcgccggtccaccatcacgttgccggtgaggatcagcccggtgccgccttccgcccaggcgcggtacaggcggatcaatgcttcggacggcgcgtggtcgcggtcggccatgttctcctccatggcggccttggccaggcggttgggcaacaagctgccattcggcagtgtcagcgaagcgaaggggttcatcgtgctctccaggggggcgatggctgcacgataggattaaagcgcgctttaaggtcaagcctggcggcgcaaaaaattccgtccccggcggcgcgcgggctattgggctcatcgctcagcgcgcgggacgctgggcgtgggatccgcaaggtccaggttgacattcaagctggctttaagcttagcatggcatcagccatcctcccttggcggaggcgtggcgcaatgtcctgtcatccggaggcgccgcccatgtccactgtccagcaagccgtcccggcggccgtcgccgtctcgcaatccttagcctgggcagggcgggggcgcgcatgaaaatcggcgaactggccaaacgcagcggcatggcggcgtcggcgatccgcttctatgagtccaagggtttgctgaagatggccagccggcaggtgaatggctaccgcgactacccgccggaagcgctggcggtgctgtcgatcatccgcgacgcgcagcaggccggcttcacgctggacgaaatcaggcagctgctgcctggcgatttccagtcctggcggcatgaggaactgctgtccgcgctgcgccgcaaggtggcggatatcgaagcgctgcaggcgcggctggcccagagcaaggcgcatctgcaggcgttgatccagatgatcgccgccaagccggacgacatggattgcaaggagaacgccgcccgggtgctggcaaaccttggcgtggcgggagattcctaagcgggctcggcatcgagccatccgcggttgatcgctgacggcatctccatctttcctgatatgccatttgaattttcatgcgtagaatcgagtggtccaagcatgtcgccggcattctgcgacggcgcggattcctctctaatccgacgcgccggctgcggcgcgcgatcgcaggagaatcatcgtgtcaaaaccgctcatcgccggctgcacggccttgtccatcttgtcttgcctgccggcgtcggcgcgcgccgatgccggctatcaggcgctggtgcagcgcacttcgttcggcattccgcacatcaccgccagcaatgaaggcaacctcggttacggcgccggctacgcttatgcgcaggacaatttctgccaactggcggaagagatggcgaccgcccgcggccagcgttcccgctacttcggcacggcgggcagttacgccagtccggatggcggacagatacccaatgccgccagcgatttctactacgccttcctgaacagcgacgcgaatatccgcgccagtttcgcgcgccagccggaggcggtgcggagtctgctcgatggctatgtggccggggtgaaccgctatctgcgcgaaaccggcgtcggcggcttgccggcggcctgccgcaaccagccgtgggcgcggccgctggagcggctggacatgatccgcatgatgcggcgctacgcggtgacttcgtccggcgcgcaatacatcggcgccttgcaggcggcggttccgccgactgccggcgcggcgcgcaagcagcggctgccggtcggccaggaaccgctgcgcggtttgtatggcaagcgccggccggtgggttccaacgccatcgcgctggggcgcgaagccacccattccggcgcgggcatgctgtacgccaatccgcatttcccctggaacggcgcttaccgcttttacgagcagcatctgaccattccgggcaaggtggatgcgatgggcgtttcgctgggcgggctgccggtggtgaacatcggcttcaaccgcgccgtcgcctggacccataccgtcaacacctcgctgcactccacgctgttcgccttgcgcctggcgccgggcgatccgacgcgctacatcgtcgatggcgtggccaagccgttgcggccggtcacggtcagcattgtcggccgcgacgccaatggcgcgccggagcgcttgcaacacaccttctatctgagcgagtgggggccggtggtggcgtttccggggcaactggattgggacgccgcaagcgcctacgcgctggccgacgccaatcaggacaacgacaggatgctggatgcctggtggcggatgaaccgggccggctcgctggcggagctgcgttccgcggtggaatcgacgctgggcctgccctgggtgcataccctggcggcggaccgcgccggcaatgtttacttcggcgacgtcaccgtggtgcccaatgtcggcgcggcaaaacagcaggcttgcatgccggcggcgacgcggcccttgctggcccagggcgtgatggtgctggatggcgcgcgcgccgcctgccgctgggacaatgcggcaggcacgccgcagccgggcatcttcgcagccagggatttgccgacgctggcgcggcgcgacttcgtgcagaacagcaacgacagcgcctggctgaccaatccggcgcggccgctgaccggctacccggacatcgtcagcgcggccggcggcgtgcagggcgcgcgcacccgctacggcttgcagcaaatactgggccggcttggcgagcagcgcttcactctggacgcgctgcaggaaatgggcttgtccaaccgctcctactacgcgtcgctgttgctggacgatctcaagcgcttatgccggacgtcgggaagcggccaggtgccggcggatgcctgccggatcttggcccgctgggatggcaaggccgaactggatagcgtgggatggccgctgttccaggcctggcgcggacgcttgaacggcagcggcgtggcctactgggggcagcctttcgatccggcgcgcccgctgcagacgccgcgcgggttgcgcatcggcgatgcggcggtggccagcgccgcgcgcgcggccttgttcgacgcggtcaaggatttgcaggccgccggcatcgcctattccaggccatggggcgagatccagcgcgcggcgcgcggcggcaaacgcattccgatccacggcggcggcggcgaagatgtctacaacgtcatcgaaagcgggccgggcggcaatggcgaactcaatccggaatccggcacctcgttcctgatggcggtgtcgttcgagtccggcctgccgcaggcagaagctttcctcacctattcgcagtccagcgatccggactcgccgcacagcggcgaccagaccgagcgcttcagccgcaagcagtggatccgcctgccatacacgcaaactgacatccgccgcgacccggcttatgcctggcgctggctgagggaatagccggcgcggccggaaaagccgccgggcgccagcccggcggctgcgcttacttcatctgccagccggtcaccttgagcaccgccgcgtcggcgttcttcaggtcggtctcgcccatgcccagcagggtgctccactgcttgacgcggttcttgccgttgggcggctggttgtagtcgttgctgtccacgatcttgctgcgctcggcgtagaagcgggtcaggaacgttttctcgtcggcgctgttgccggagcgggacagcacgccggccagcgtgccggaatcgccgctggcaccctggttcagcgcggtgtcgacgaaggagcctatcgtcagcgcgctgttgaagccgcgctggcgcgcctgctggacgctgaactggatgtagacggcgtagaaggtgcgccacatcgcttcgcgccaggcggcgttgttctgcagcgcgcctatcttgttgcagaaggttttcttgtcgtcgctgatcttgagaatggcgccctgcatcgcgccgtgggcgccggcgcggttcaagccgccgattatcgacgggttggccgcgccgctggcggcgtcgaatgccttgaacagcgcaggggcgtccgggccgccgtcgttggggccgccggtggtggcgccgaaaatgccgatggtgaagccgcgcttgtcgccgatgtcctcgcagtagccgtagaacttggtccaatccagcgagtcctgctccggcttgttgatcagcttcatgatgttgtcccactgctcgccgtccagcccggtgttggccttgagaaactgcagcgtggccggcgagaagttggcgtcatggtcggccgccttggcggcggtcttggccgccggccggcaactggcgccggctatccagggctggccggctcccgcgctgtccgccgacggagcattgccctgggtccagtaggcggcggtgtagttgacgccgccgcggctggccaggctgccggcgggatagggcgcggcggcatcccaggccgcgccgcaggcctggagatgggcggcttgccgggccggcgcgccggcatgggagccctgggccgcggcctgattcgccagagccagcgcggccagcaggggcaggcaggttttcaggatggtggacagctgtcttgcgcttgcgtttttcaaagcgttctccgaaatggttgcgaagtagcgcggcggtcgccgctgcggacaggcggtcaaacaaacgcttttatatgccatttgattttttacggcaactcgtacatacgacttttgcgaataagtaactacttgatatgaaaaatactttatgaattttgactaggctggccaggatgttttgccaggcaagcatgacgccggggcgggcaagcgcgctggctatattggatgatggatgcgtaatgcgcgcggaaagctggtgtggcggaggggaggcaagcatggctggcgggagggctgtggcggaaaggatgcgggcgccggctttgcatccggcgatgtcgccccggcaagctggccgggtggtgacggcggcatgcctgcgccatttccaggccaatctggcgggcgccaaggccggcgtcgaccatgagtgcctgcaccaggccagggtggcgctgcgccggttgcgctgcgcgcgcaagatattctccgcccgcgacgcggatggggatgcggcggccgccgatctgaaatggctggccggccagctcgggcaggcgcgcgatctggacgtgctgctagtggaggcgctgccggcggcagaggccgcggcgggcggcggcgcaggcttaggcaagctgcggcaggccttggcgcagcgctcggagcgctgccggcgcgaggcgcaagcagcgctggagtcggcttgctgtgagaggctgttgtcgtcttgccgccatccgcagcttgaggacgcggacgccaagctgcggcgcttcgcccggcggattctgcggcggcggcggcgcgggctgcgccgcttggcggagcgctggcggacgctggatccggaacagttgcatcagttgcgcaagcaagccaaggcgctgcgctatgcggcggaattcttcgcgccattgttcgacgccggcgcggcggcgcgctatctgttccgcctgcagcgggtgcaggacctgttgggcgcgattcacgacgcggcggcgggccgggcgctgctggcgcagtgcggcccggcggaagatggcgagctggcgcgggcggcgggctttgtcgatggctggctggcccaggcggcggcgcaggccgggcagcggctgggccgggcgctggcgcgcctggagcgagccaagcgcttttggtgaggcggccgctggcttagccgcgggcgctgctggcgccgccatccgcgaacagcgccgcgccgctggtgaagccggacaggtccgatgccaggtacagcgcggcgccggcgatttcggccgggctggccagccgtttgagcgcgtgcaggttttccacccaggcgcgctgctccgcggtcggcgtcgccgcctgccccatctcggtatcggtgccgcccggcagcagggcgttcacccgcagcccttgcgcgccatactccgccgccagcgatctggtgaggccaaccagcgcggatttggcggcggcgtaggccgccatgcccggcaggcccaccgcgtggccgacgaaggacgaggtgaagatcagcgaggccttgccttgtttcagcatggcgggaatctggtatttggcgcagaggaaggcgctggtgaggttggcgtccagcgtgcggcgccagtcgtccagcgccagatcgggcaggctgccgggcgcgcccagcgcgccggcgttgttgaaggcgatgtccagggcgccgaaacggcccagcgccagttccaccatcgcttgggcggcgcgctcgtcgctggcgtccgcggccagcgcggcggcctggccgccggcggcggcgatttcgtccaccaggctatccagcaagtggccccggcgcgccacgacgacgaccttggcgccctcgcgggcgaacagcagggcggcctcgcggccgatgccggagctggctccggtgatgatggcagttttacggtctagcaagcccatttggcggcctcatgtctgatgaaaggaatgaggccccagtttccgcgatgccgcgccggcgggcattccgattcttgccgacttcaatccggccgggcggaggatcgcgccgcgcgccaggctggcagatcggccagccggatttgcgccggcaacgcgccgtgcttggcctgggccacccgctgcgcgcggtagatgccggcgtggccggagcacagatagctgaccacgcaggctagcgcggcgtagacgccggcttcggggccgaacagctccatcgccatcacggtggaggccagcggcgtgttggccgcgccggcgaacaccgcggcgaggcccatgccggccagcagggggaagggcagctgcagcagcggcgccagcgcgttgcccagcgtcgcgccgatatagaacagcggcgtcacctcgccgcccttgaagccggcgcccagggtcagcgcggtgaaggccagcttgccggcgaagtcgtagctgggcagcggctgctggaaagcggcggcgagagtgggcaggcccaggccgagatacgcgtcggccgggagcaggctggcggcggcggccaccatggcgccgccggccaatggccgcagcggcgcgtagcggatgaagcgtttgaacgctccgccgacggcgtgggtcgcgctggagaacagcctggcgaccaggccgaaggcgacgcccgccagcaccgcggccagcatgttccaggcgttcaggggcgggacaaagggaatggcgtaatggctgtgctggatgcccagcgccaagcccagcctgtcggcggccaccgcggccagcaggcagggcaggatggcgtcgtagcgcagctgtccgatggccagcacttccagtccgaagacggcgccggccagtggcgtgccgaacaccgaggcgaaaccggcgctgatgccggcgctcagcaggatgccgcggtccgccggccgcagcggcagccagcggttgagctggtcggccagcgcgccgcccatctgcaccgcggtgccttcccgtccggccgagccgccgcacaaatgggtggcgatggttcccgccagcaccagcggcgccatccgcaacgggatgatgcggcggggatcgtggatttcatccagcagcagattattgccggcctccacttcccggccgaagcgcaggtaaagccagccgacggcgaagccggcgacgggcagcagccagatggccgccggatgggccaggcgccagcggctggcccagtccagcgccagcaggaagaaagcggatgcgcagccggcgagcgcggccactatgccggacagcaacagccatttgccgaggtggggcagcggggcgagccggcggatgagttgggtgtaaggcatggaagtccatcgtctgatcgcattgaacaaacctggacaggagaaaaccggggcgcgcccacagcttccctggccagggaacgctgtaggcatcatcagcccttgtgggcggttggcggaggaatgccatctccatctgaagcgtagattctagggcgcggcgcgcgcggcggcaagtccgggcgcggattgtcatcgtgctcctgcaacgatggccttgctgtcacctgtctgaaaggccattgctgtccttacggtcgctacctatacctgccgcatgctttggaaattcccccttgcgcgacatggcgattgcctcggcatgcatccgatgcaagtggtgcagcccttcctctttaaggcagttccatgcgtacaaggagccgatatgagttatctgcagtttccccggctggcgttcgccggcagtttccaggccgatgtctccaccgtcaacaacgacccccgccactacgacatcgacaatttcgagcccgcgttccaggatttccagaccaagcagtcgtacaacggctggtggcatcccaccggcaccgccatcatgcgtttcgccgactgccaggtcaccagcctgcgcgggccggacggcgtgctgatcactgaatccgggctcgacccgctgctgtcctgtacggtgggcaacgccatcggcaagccttcaggcaagatggtggatctggatccggactggcagctggcgtccaatctctatggcctggcggtatcgctgctcaggccggacggcacgcccatcatgaccgccgactacgaaagcaacccgtttcgcgacctgtggttcacccgcggcagcggtggcggtgacagcggcgcttcggcgatgtttcagtcggtgctgacgaatgtcgagtggcatctggacgatttcgacagtcccctgctggatcagttgatccgggtcagcgagcaggggcggctatctgtccgcctgagcacctatggctacaatatggacgcgtccaacccgcgcttcggctacggcacggtgctgggcgccatcggtcctgtccatgcgggacagccgcgctccttcatcctggggcgccgtttcatgcccactacccagcagggcgccgatctggtcagcagcaacggcatcggctgtttttcctcttatatagacagcgccagcggcagcttgcaggtggacctgagcaacgccttgccgctggggccggataaccaggtcaagtacctgggcgttttgcagtacgcgatcctgaaaaacgcgttgaccgcgcaggacgccgaaatcgggccgggcgattacatttacctgggaacggtggacacttcgcaggcgctgcagaatgtgcaggctggcatccagtcgctgccgctgagcggcgatgccttgcgccagaccgagggccagccgctggccatcatccagatcaacgacagcaacggcaacgcgcaggtctgcgtgcgcgaggcgctgctgggtaatgaggtgagggtcgaggacttcgccactcggctggaccccaacgatccggcgaaaaaccgcctcgtcaccaccctgtacgcggctacctacggccagccggcggcgggggcgagaatggagttctgggcggcgggcccggcgctggattacgacaacacgcccaccagcccggatgccgccaccacgccgcgggcgctgctgcccgtcaacaatgtgcccggcggcgcgatccgcatcgagccgcgcgaagtggtgaccggcgccgatggcaccgcgcagttcacggtgcacggccccgagttcatggcgacgccgcgcgaatacatggacggccagttgttcaccatcaattacaacttcgccggcgacaatccggcggtgcagcaaccttacgacaatctggcgctcatggtgttcagcacctatccgcagcctgggcagcaggtgaacctggaacacccgcgctgggacgatgtgcaacccatcctgcagcagtatgccaatctctatccggtgatgagccagggcttgttcgacttttccaagcagggcgtggccgatgcctgcgccgccatcatgcgcttcgtgttcgacaagccgatcgaggatccggaccagatgccggtcacccgcgacctgtcgtccagcaagcggcggatgctgatcaattactttcaggatgtgatggaccgcaccggcaacaccatggaccggcaactgatgttcggcaaacgttgtccgttgcggcccagcgcgatgcccggcgaggcggacatcgccgccgcgcgcgccgcgcccaccgccagcaagagccgcaaggccggccgctgagccggtcatcccatcgcccgacaagagaaagaagagtccatgctgaaaattcgtccagaattgatggccaagctgcgcgcggccgcttccgttgaggatgtgcgggaaatgctggccggcgcggtgcggctggaactggccaccatcccgccttacctgaccgcgcagttctcggtgatgccgggccagaaccaggcgtcgcgcgcgctggtgcagtcggtggtggtggaggaaatgctgcacatgacgctggcggcaaatgcgctgatcgcgatcggcggcaacccggacatcgtggcggacggccgcagcctgcagtatccggggccgctgccgatgtgcgtcgacgaggggctgacggtaacgctgaagtcattgacccggctgcaggcgttcgaggtcttcatggcggtggagcggccggataccgaggccatcctgccgggcgagacggcgccggaactggccgacaactccggctacgagtctatcggcgacttctatatggccattctgcacaagctggaagaactggtggcagccggggtgccctgtttcgcccgcccgaggctggagcaacaagtggatatcagcaagtggttccctcccgaggtgccaggccatccggaaggcaaggtttacgatatcggctccgcccgggcggcgatcatgaccatcgtccgccagggcgaaggcctgcagatccaggacgacaagatcaacccaaaggaagacccgagaggcggctacgcccattacttcaagtttggcgagatctattacggcaagcgcctggtgcgcgacccggccagcgtgtccggctggtcgtacagcggagaaccggtgccgctggatgaaaccggcgtttatccgctgctgcccaacgccgccttgtccgactacgccaagggcagcggcgcggcggtcagcggcacgcagttctaccaagcgtatcaaaacctgctggtggcgctgaaccgcaccttcaacggcgagccgaatcagctggatgccgcgctgggcatcatgtacgagttgaagctggtggcgcagaaagtgatgcagaacctggccaaccctgacgtgcccggcgtgctggcggctccgccgttcatgcgtacccatcatcctgacgaagagtgaagccgtagataaagaacggccgccacgccttaatcagggcacggcggccgtttcgcttggcttgcggcggactcagtcctggcgcgggggcggctccagcaccgtgtcgcgggcttgcggcagcaggtcaggatagtcgcggctgtagtgcaggccgcggctttccttgcgcagcagcgcggagcggacgatcagctccgaggtctgcaccaggttgcgcagctcgatcaggtcgttgctgacgtggaagttgctgtaatactcgtcgatctcgcccttcagcagatcgatgcggtgcagcgcccgttccagccgcttgttggtgcggacgatgccgacgtagtcccacatcgcgcgccgcagctcgtcccagttgtgcgagatcaccacttcctcgtccgggtcggtgacgcggctgtcgtcccaggccggaatcgccggcagtttgatggcgtcctgcgcctggatgtcggccgccgcggccttgcctatcaccaggcactccagcagcgagttgctggccaggcggttggcgccatgcaggccggtatgcgccacttcgcccaccgcgtacagtccggccacgtcggtgcggccggccaggtcggtgacgatgccgccgcaggtgaaatgcaccgccggcaccaccggtatcggctgctgggtgatgtctatgcccaactccaggcagtgggcgtagatattggggaagtgttccttgatgaattgcgccggcttataagagatgtccagataaacgcagtccaggccgtgcttcttcatttcaaagtctatcgcgcgcgccaccacatcgcgaggcgccagctcgccgcgcggatcgtgctgcggcatgaagcgggtgccatccggcagtttcagaatgccgccttcgccgcggacggcttcggtgatcaggaaggatttggaatgcggatggtacaggcaggtcggatggaactgcatgaactccatattgccgacgcggcagccggcgcgccaacccatcgcgatgccgtcgccggtggcggtatccggattggtggtatagaggtaaaccttgccggcgccgccggacgccaggatggtgtgctgggcggcgatggtgacgacctcgtcgctgttcttgtccaaggcgtagacgccgtaagcgcgcttgccgtcctggcccagcttctgcgacgtgatcaggtctatcgctatatagtgttccagctcggtgatgttcggatgcgccttgatcttctggcccagcgtgctggtcaccgcggcgccggtggcatcggcggcatggatgatgcggcgatggctgtggcccccttcgcgcgtcaggtgataaccggtctgatgctcgtcgtcgcgggtgaagggcacgcccagctcgatcagccagtctatcgcctccttggagtgctcgacgatgaagcgggtggtgtcttcattgcacaggccggcgccggcgatcagcgtatcgcggatgtggtcttccaccgagtcgtcggtatccagcacggcggcgatgccgccttgggcataagtggagctgccttccagcaggtcgcgtttggtgatcaggcccaccttgcgtttttccgccagatgcagcgccagcgtcatgccggccaggccgctgccgataatcagcacatcgaatttgagcatatatagagtgtccacggcaggcacgttgcgtgccaaacgcatggaagcgtagcagaatcgcctgttggcgcgtagccgacgccgcatttccggtggccagccaggtccgactgtggcggttttcttgccgcaatggctgcgggcctgaaattctttctcacggcttttcttgcaaatcaataccttgcgcgggccggtcgaagaaagttcattttttgtggcgaaaggtgttgacgggtgtgggtcccgggggtatagttcgcctcctcagctgacgcagcgaacgaaacggcggaaacgaaacggttccggtgatggcgacgcagcgatcggcaccgctctttaacagacagaataaccgataggtgtaagtgtttggcgaaagccaaaaacttgcactgcaagagacaagagatacttgtttatttctttgaacttgcgtgccagaaaatttgctatgagattgaactgaagagtttgatcctggctcagattgaacgctggcggcatgctttacacatgcaagtcgaacggtaacacaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgcntagccggtgcttattcttccggtactgtcatccccgccaggtattaaccagcgggatttcctcccgaacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtgagctcttacctcaccaactagctaatcagacatcggctgctcgtataacgtgaggccttacggtcccccactttccccctcagggcgtatgcggtattaatccggctttcgccgagctatcccccattacacggtacattccgatgcgttactcacccgttcgccactcgtcagcggtgcaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgcctgttaaagagcggtgccgatcgctgcgtcgtcatcaccggaactgttttgtttccgctgtttcgttcgctgcgtcagctgaggaggcgaactatacgcccgggacccacacccgtcaacacctttcgccacaaaaaatgcaaaaagatggcggaagaacacgcaaaccattgataaaccatcaatatgacacaaaaagaatttcagctcttcatgaaaaacgccgcgatccgcggcgttttcgctgcactccgtgccctgctacgcggcctcaaggctgcgcgggagcggccggcggcttcagatagggcagaaaagcgtccaccacttccggcgcgtccggtttcgtgcgggtggagatgctcaccaccttgctcgcgcccggcaggatcaggtacttgtggaagttccacaccggcgcgtcgtcggtggcggcgatcaacgccttgaagaaaggctgcgcgtcgccgccgcgcacgtggcccttgccggccatcggaaaggtcacgccgtaattggcctggcagaacgcgccgatctcgctgggctgatccagttcttggaagaaatcgttgctgggaaaaccgatcaccaccaggccgcgcggaccgtattgcttatatagagactccagctgggtgaactgcggcgtgaagccgcaatggctggcggtgttgaccaccagcaccggctgctccgcgtactggcacagattgatctcgccgcccatcaagcccggcaccttgtaattgagcaatggcgggcacgcggccaaggcggcctgcccccatagcaacagcagatatccccaacgtttcatgacgacctccccgccggatgcgccacccggctttgctccagatataagaatagggcaatgcgcccgcgcactgccccatcctctcacatcgcggcggcacgcgccgccggcctgtcattccggctggctggcgatttccgcgcgcaccttgtccatgtccaagtcccgcaggctctgcagcaactgctcgaactgcgcgcccatcatcgcgccggcctggttgaagaccatgatgccatccttgatggcgatcagcgtcggaatggagcggatattgaagtgggcggccaggtcgcgctcgtcttcggtattgatcttgccgaacacgatgtcggcgtgcttttccgccgccgcctcgaacaccgggccgaacatcttgcacgggccgcaccacggcgcccagaagtccaggatgaccaacccttcttccctcatattggcgttgaaattgtcggcggtgaggttgatataagacatggcggctctctttcgtaatcgggtggcccgccagcggcgggctgtctgccatcaagatatgagcggccccgggccattgcaagcgatcgcgccggttgtatttttcaatccggccgatagcccgctcagccgacgaagggcaaagccaggtacagcttgatcacgatggcgttgacgatgtcgatgaagaaagcgcccaccatcggcaccaccagaaaggccagatgcgaggggccgaagcgctcggtcaccgcctgcatattggcgatggcggtgggcgtcgcgcccaggccgaagccgcaatggccggccgccagcaccgcggcatcgtagttgcgccccatcacgcggaaggtgacgaacacggcgtacaaagccatcgccagcgtctgcagcagcaacagggcgaagataggcaaggccagcgccgcgaggtcccacagccgcagcgacatcagcgccagcgccaggaacagcgacaggctgacgttgcccaccaccgatacctcgcgctcgaaaaccttgtaccaacccagcgccgccaagccattgctgatcagcacgccgacgaacagcacgcagacgaaagtcggcagctcgaaagccgtgcctttcagcaggccgccgagaaaagtgccgcccagcaggcagaccgcgatcaatgccagcgtttcgatgaaggaatgcggcgtgatcagccgctgcgcgtccggctgctcgaagccttgcggcggctgatcggcgttgtgctcggcgcccggcgtattcacccgcttgaccagaaagcgcgccaccggcccgccgatcaggccgcccagcaccaggccgaaggtggcgcaagccatcgccagttcggcggcggaggccaagccgtacttgtcggcgaaggtgccgctccaggcggcgccagtgccatggccgccggacaaggtgatcgatccggccagcaagcccatcagcgggtccagccccagcgcgctggccaccgccacgcccaaggtgttctgcaccaacagcaggcccaccaccacgccgaggaagatgcctaccgacttgccgccctgcttcaggctggccaggttggcggtcaggccgatggcggcgaagaaggccagcatcagcggcgtttgcagcgaggcgtcgaagcgcacctccacaccggaaaactgccgcgaggccagcaaggcggccgcgaccagcaggccgccggccaccggctcggggatattgtaggtgcgcagcgcgccgctatgggcgaccagtttgcgccccagcagcaggaccagcgaggcggccaccagcgtgccgtagaagtcgagttggatcatcggttctccctttatcgttttcgagcgaaaacgcgtccgcggcgcggcgcagacaaaccgatgaatcaggaaggcatggaggcgctccacatcccgccgctggcgcggcgaggcggcgcgaaggccgccggctggctggtcggcgactccatgcggaaacgcgctttcttataggagagcggaagcggagaaaaagttcgcgtaaaaactttttacaatcagcggcatgcgttcgtcagccgcggctgatctgccagcactggtggatcttgcggttgcggaagtcttccggcaccgactgctcgctgatatcgcggatctgataatcgccgcgcagacgctcgtccagcgcgaagctgcgcaggttgttggagaagtacagcttgccgcccggcgccagcagcgccatcgcgtagtcgatcagccagacgtggtcgcgctgcacgtccaggatgtcgcgcatcttcttggagttggaaaaggtgggcgggtccatcacgatcagatcgaactgcttgccggcgtccaccgcctcttccagatactggaacacatcggcgcgcaccagcttgtgccgggacgagtccaggccgttcagctcgaaattgcggcgcgaccagtcctggtaggtattggacatgtccaccgtctcggacgacgccgcgccgccggcgccggcgtagacggtgaagctgccggtataagcgaacagattgaggaagcgcttgcctgccgcctcttcgcgcacccgtttgcgggtgttgcggtggtcgagaaacaggcctgtgtccagatagcggtccagattgacgatgaagcgctggccgaattcctcaacgatgaaatcgtcaccctcgcggcccaccttttcgtattggctgacgcccttctggcggcggcggttcttcagcgtgacggcggcagcggcaatgccggtcacttgctcgatagccgccaccaccgcgtctatccaggcgcggtagtcgtcgtcggccatttcccagccggtgtcgtactcctgcagatgcaccttgccgccgtagatgtcgaccgcgaacgggaactgcggcacgtccttgtcgtaggcgcgccaggcgtccagcccctggcggcgcgcccatttggcgtaatgcttgtaattcttggccagacggttggcgaaggcgctgacatcctgcatggctatcctcgagacggcaaaacaaacgcgccagacgaatctggcgcggctggtgattcaaaaccgcattataagcgctattgctgcgaatacatcgccagcatcttgcgatagaccggctccggcaggtattggcggatcatcccttcccagccgcgcggccccaccaggcccttgaccatggtggacgacacctcggcgtattcgcgcggcggcagcaggaacagcgtggtgatgtccgggtgcaggtcggagttgatgtagcgcatcgtgcgttcatattcatagtcgctggcggtgcggatgccgcgcacgatgtaattggctcccacgctttgcgcgtagttgaccagaaactggttttcaaacacgtccacccgcagcttgctgaagccggcggtgacttcgcgcagcagccccacccgctgttcgacatcgaaggtgcagtgcttgtccgggttcaccccgaccgccacgatgagttcgtcgaacagttccacggcttcgcgaatcatccacaggtggccattggtcaccggatcgaagcttccggcatacacggctctcttcaattgacgttttcctttggattttggcatgagttccatggcgaatgtatcttgcgaaggcgggagggtaaaggaatatttgtgcgatgcggcaaaacggcgccgcaccgcccacattgtcaaaattctgtcacaactggcagttgatcatccagttgacgccgaatttatcactaaaacagccaaaaagcgcattccaaaaagtcttgcccagcggcaccgtcacctgccccccggcgctgagcgccgcgaaagccttctccgccgccgcggtgtcgccgtccaggttgatcgacagcacaatctgctggctgggcggcgccggccggtcggtgtcggaaatcatcagcacattggcgccgaacgccagccgggcgtgcatcacccagttcgggtcgatatcgcccatcggcggcgtgtccttcggcgcgtccgaataacgcatcagcatcgcgatgtcgccgttcaaggcctcgcggtagaactgcagcgcctcttcggcgcgtccgttgaaattgagatacggatacacatgcatggcaagcctccgtcagtggtgggaaagccagtgtacgcccgcgcttacgacaatgaaatgaaaaaagcccgcgccttgaccgcgcgggcttgcttgtcggcagggccaaggcctagccgttgatctcctcggcgcggtggcaggccaccatccgcgcatccagctcgcgcagctgcggcacctcgctcttgcagcgctcgttggcatgcgggcagcgcttgtggaaggcgcagccggacggcggattgagcgggctgggcagctcgccctcgatcttgatcttgacgcggcggtcctccggatggatggacggcgtcgccgacagcaacgcctgggtgtacgggtgcagcggccggtcgtagacgcggtccttggcgcccacctccaccgcgcggcccagatacatcaccatcaggtcgtcggccacgtgctccaccaccgccaggttgtgcgaaatgaacacataggcggtgttgaactcttcctgcaggtccatgaacaggttcaacacctgcgcctggatcgatacgtcgagggccgaggtcggctcgtccgccaccacgatcttggggttcagcatcatcgcgcgggcgatggcgatgcgctggcgctggccgccggagaacatgtgcggatagcggaagtagtgctccggacgcaggccgacgcgggccatcatgcccctgaccttctcttcccgctccttcgccgacagctcggtattgatcagcagcggctcggacagctggtcgccgattttctgccgcggattcagggagccgtacgggttctggaacaccatctgcaccttgcgccgcatcgccttcagctcggcgccgccggccttggccgcatcctggccgtcgaggatcagcgaaccggaagtcggctgctcgatcagcgtcaattggcgcgccagcgtgctcttgccacagcctgactcgccgaccaccgccagcgtgcggccggccgacaattcgaacgatacgccgcccagcgccttcacctgcgccttgggcttgagccagccctgcgccacatcgtagtaacgggtcaggtcccgcgcttgcaaaacgctagtcatgctgcttctccttggccagcaacgggtagtggcaacgcaccgcgccattcggctgcggcgtgagtcccggccgctggctgcggcagttctcctgcacatacggacaacgcggcgacaacaggcagccgctcggacggtcgtattgtccgggcacgatgccgggcaacgtcgccagccggcgcgcgcccttgctgtgctccggaatcgacgacaacagcgcctcggtatacggatgggccggctggcggaaaatgccgggcacgccgcccacctccgccgactggccggcgtacatcaccaccaagcgctgcgcgacttcggccaccacggccagatcatgggtgatcaggatcagcgccatgttctggctcttctgcagactcaccagcagctccatgatctgggcctggatggtgacgtcgagcgcggtggtcggctcgtcggcgatcaggagcttggggttgcaggcgatggccatcgcgatggccacgcgctggctcatgccgccggacagctggtgcggataggcgtccagccgcgaagccgcggccggaatctccacctgctgcatcagttccagcgcgcgcgctttcaaggcggcgccgcgcaggccctggtgcactttcagcacttccatgatctggtagccgacggtatagctgggattcagcgccgtcatcggatcctggaagatcatcgagatatccttgccgacgatcttgcggcggccgcgcgcggagatggtcagcaagtctttgccgtcgaagctcagctcgtcggcgacgatgcggccctggccttccaacaggcccatcatcgccatcatggtgaccgatttgccggagccggactcgccgacgatgccgacgatttccccttgcgccacagtcaggtccagcccctccaccgcgcggaagggatttttctcggcgccgaactccaccgacagattcttgattcgcaacagactcatgtttcttatcctcaggcggcgcgcttcagcttcggatccagcgcgtcgcgcaggccgtcgcccatcaggttgatcgccagcaccgacagcagaatggtcaggcccggcagcgtcaccacccaccaggcgctctcgatgtaatcgcgggccgaggccagcatggtgccccactcggcggtcggcggctgcacgcccaggcccaggaagcccagcgcggcgatttcgagaatggccgaggaaaagctcatggtggcgtgcacgatcagcggggccatgcagttgggcagcacggtgacgaacatcagccggaacaggccggcgcccgccacccgcgaagccaccacgtagtcgcggttcagctcggtcatcgccgaggcgcgggtcagccgcacgtaagccggcaacgacacggtggcgatggcgatcatcgcgttggtcaggccggggccgaggatggccatgatggccaccgccagcagcagggacggcaacgccatcatgatgtccatcaagcgcatgatggaagcgcccagcgccttcgggaaaaaggcggccaacagccccagcaccacgccggggatcagcgccatcagcaccgacatcaggccgatgaacagcgacagtctggcgccgtggatcaagcgtgacaggatgtcgcggcccaactcgtcggtgccgaacaggaactgcacgctgccgccggcctcccaggccggcggggtcagcatgtggtcgcggtactgctcgatcgggctgtacggcgcgatgacaggcgccaacagcgcacaggcgacgatgaacagcacgaagatcaggccggcgaccgcgcccttgttgtgggaaaagccctgccagaactccttcagcggagacggataagacagcgccaggtcggccggggccgcgttttgcttggtttggctcataatgcgtccctgcttacttggcgtgacggatgcgcgggttggcgatgccgtacaggatgtcgacgatgaagttggtgacgatcaccagcgtggccaccatcaaaatgccgttctgcaccaccgggtagtcgcggcgggcgatggcgtcgatcagccatttgccgatgccgggccaggagaagatggtctcggtcagcaccgcgccgcccatcagcgtgcccacttgcaggccgattacggtcagcaccgggatcagcgcgttgcgcagcgtatggatgaagataacgcgggcgggcgacaggcccttggcgcgcgcggtgcgcacgtaatcctcgcgcagcacttccagcatcgacgagcgggtcatccgcgcaatcaccgccagcggaatggtgcccagcacgatggacggcaggatcaggtggctcagcgcgctcttgaacgcgccggcgttgccttccggatcggccatctcggccagatagctgtcgatcagcatgaagccggtgcgcggatggatgtcgaacatcaggtccatgcggcccgacaccggcgtccagcccagcttgaccgagaagaacatgatcaggatcaggccccaccagaagatgggcatcgagaaaccggtcagcgaaatgcccatcacgccgtgatcgaatagcgagccgcgcttgatcgcggccagcacgccggccagcaagccccagacgacggcgaacaacagcgccgacagcgccagctccagcgtggccgggaacagggtcttgaactcggtccagacgcccaccttggtcaccagcgattcacccagattgccgtgcagaaggttggtgacatagtcgaaatattgcgcgtacaaaggcttgtccagccccagacgatgcagcgcctcggcgtgcagtttgggatcgagcgtgcgctcgcccaccatcacttccaccgggtcgccgggaatcatgcggatcaggccgaacgtgagcagcgtgatgccgaagaaggtgggcaccagcaggcccagcctccgcagaatgaatgcaaacatggataaacctctcctggacgcaggcgcggcctcgaacgccgcgcgcgccatctaacccagacatcgcgtgcaaggaatcgacacaggaaaggaaaacggatcgcctctcggcgaagggagaaaaaagggtgccgggcagcggacaggcaactaaaccacccaccagccttagctgcagccactgccgcggcgaggaaaacgatatcagcgtccctcttcccgcggcttgacgcaggtcaagccggctgcaagccgcccctcccgcgttccactccattcctgtgcagatactgccatgtcggcgccggcgccctctctgccggacggctgtcaacgcctacacttgtcgccaggcggcggggagcgagctccccgccgcctcgttctgaaataacgcctttttcaggccagccttacttgatgctgacgccgtagaaggagttcatgccgaacggactgaccttgaagccctgcaccgacttcagcatcggctggttgacggtggagtgcgcgatggtggtgtaaggcagttgctgcttcacgatctcctgcgccttcatgtacagcttggtgcgttcggcgacgttggcggtggtcttgcccttctggatcaggtcttcgaacggcttgtagcaccacttggtgaagttgttgccgttcagcgcctcgcagcccagctgggtgctcagccaattgtccggatcgccgttgtcaccggtccagccgatcagcatcgcatcatgctcgcccgccttggagcgcttgatgtattcgccccattcataggaagtgatcttggccttgacgccgatcttggcccaatcggactggatcatctcggccatcagcttggcgttgggattgtacgggcgctgcaccggcatcgcccacaaggtgatctcgaaaccattggggtagccggccttggccagcagcgccttggccttggccacatcgtacggcgcgtccttcaggctcttgttgtacgaccactgggtcggcggcatcgggttggtcgcggcttggccggcgccctggtacaccgcttgcaggatggccttcttgttgatggacatgtccagcgcctggcgcacttccagcttgtccatcggcttatgccggacgttgtaagccagatagcccagattgaagcctgcttgcgagatcacgtgcattttcggatccgccttcatcgccgggatgtcggtcgggcgcgggaaggtggtgatctggcactcgccggccttcagcttctggtagcgcaccgaggcgtcggtggtgatggcgaacaccaggttgtcaaccttggggccatccactttgtcccagtactgcttgttggcgacgaaacggatctgcgcgtccttctggtagcgcttgaagatgaacgggccggtgccgaccggctgctggttgatcagctgcggcttgccatccttcagcagcttgtcggcatactcggccgactggatggaggcgaagctcatcgccatgttctgcacgaaggcggcatccacctttttcaggccgaacttgacggtatacggatcgagcttctcgatcttgacgatgttcacgtccatgctcatgtcggagaagtacgggaactcggtcgggtaggctttgcggaacggatggttcttgtcgatcatgcggttgaaagtgaacagcacgtcgtcggcgttgaaatcgcgggtcggcttgaagtagtcggtggtctggaacttcacgcccttgcgcagatggaaggtgtaggacagtccgtcagcggaaacatcccatttttcggccaggcccggcactaccttggtgccgccgcgctggaattgcaccagccggttgaatacggtttcggccgaggcgtcgaagtcggtgccggtcgtgtactggccggggtcgaaacccgccggactgccttccgagcagaacaccagagtacccgcggcatgcgccgccaatgaagagcccgcgaccacgccagcaaccagcagcttcttgaaagcttgcataatgtttcccttttcctttgtacagaccgttaaagtctttttctgatagtcaacctgagccttgagacttggctggtgggggatacattatgcacagagggcgcttttgacaagcgccctctggcttttttatgcggacggcagccgcgatcgcggcagccaaggcggcggactatcgcttcttcagcaccaccgacccgacggaatagcccgcgccgaaagaagaaatgacgccgacatccccagccgcaagatcatgcgaatggagatggaaggcgatgatggagccggccgaactggtgttggcataacgatccagaatcaccggcgcctccacattgtcggcctcgcggcccagcactcgcttggcgatcagctggttcatcgccaggttggcctggtgcagccagaaacggcgcacgccctccggcgcgatgtccaggctgcccagatgcgcgacgatgtgctcgcccaccatcggacacacctctttgaataccttgcgcccctgctgaatgaacagcttgtccggctggccgacgccggcctcgtcgcagcggttcaggaagccgaagttattgcggatattgttggagaacaccgtggccagcttgcagcccagcacttcgaaacgctgcgccgaagtggccgcgtcggcgcgctccagcaccaccgcggtgcaggcgtcgccgaagatgaagtggctgtcgcggtcgcggaagttcaggtgggccgagcagatctccgggttcaccatcagcaccgcgcgcgcctggccggtggcgatggcgccgaccgcggtctggatgccgaaggtggcggacgagcaggcgacgttcatgtcgaaggcgaagccggcgatgcccagcgcctgctgcacctcgatcgccatcgccggatacgggcgctgcatattggagcaggcgacgatcaccatgtcgatgtcggcggcggcgcggccggcggcttccagcgcctggcgcgcggcggccacagccatctcggcctgcagcgacaattcgtcattgccgcgctccggcagatgcggcgccatccgcgccggatccagcacgccgcccttgtccatcaggaagcgctgcttgatgccggaggccttttcgatgaattcggcgctggattcggccagttccgccacctctcccgcgtcgatggccgcccggttggcggcattgaagtcgcggacgtaggcgttgaacgcctccaccagctcggcattgccgacggcatggggcggggtgaacaggccagtcccgctgataacaaccttatgcatgttgatttgtcctttttcacccgcgggcgcgggagcaaacatggcggccagcctatgcggccgaatattgccgcgattttacacaagcccccgcaaaaagtaagaaatccatagcccgcaacaagttaaacctagtaaaatgctcgactttgcggcatgcggtggcggttgcgcctgacaaatacttgactaatttagtcggatattgggtataatccgtacagtaccaccacccaccggaacgaaaaacatcatgcgcctcaccaccaaaggacgttttgccgtcacagccatgctggacctcgccatgcgcgaggaaggcggcccggtcacgctggccggcatcagcgaacgccaaagcatctcgctgtcctatctggagcagctgttcggcaagctgcgtcgcgccgagctggtcgacagcgtgcgcggtcccggcggtggctacacgctggccaaggagacgcacgaaatcacggtggccgacatcatcgtcgccgtggacgaaccggtggatgccacccagtgcggcggacgcgaaaactgccgcggcagccagcgctgcatgacccatgacttgtggaccaacctcaacgtcaccatattcgactacctctccaaggtgagcctggccagcctggtcgccgagcagcacgccaaggagaccagcgtggtgcaggacaagcgcgatagctgtagcacccctcaccttgccgctgccagccgagccctgtaagcgccccgaaatcttgtggagattatgcaaatgagccagcccaagctgccgatctatctggattactctgccaccacgccggtggacccgcgcgtcgccgaaaaaatgattccctacctgaccgggaagttcggcaaccccgcctcgcgcagccacagcttcggctgggaagcggaggaagcggtggaaaacgcgcgcgcggaagtggccaagctgattggcgccgatcccaaggaaatcgtctggacctccggcgcgaccgagtccgacaacctggcgatcaagggcgccgcccagttctacaagagcaagggcaagcacctcatcaccgtcaagaccgaacacaaggcggtgctggacacctgtcgcgaactggagcgccagggcttcgaagtcacctatatggacgtgcaggaaaacggcctgctcgacctggaggccttcaaggccgccatccgcccggacaccatcctggtgtcggtgatgtatgtgaacaatgaaatcggcgtgatccaggatattccgcaaatcggcgaaatctgccgcggaaaaggcatcatcttccacgtcgacgccacccaggcgccgggcaaggtcaagatcgacctgaacacgctgaaagtggacctgatgagtctgtccgcgcacaaggcttacggccccaagggcatcggcgcgctgtacgtgcgccgcaagccgcgcgtgcgcctggaagcgcagatgcacggcggcggccacgagcgcggcttccgctccggcaccctggccagccaccagatcgtcggcatgggcgaagctttccgcatcgcccgcgaggaaatggacggcgaatgcgaacgcatccgcatgctgcgcgaccgcctgtggaacggcatcaaggacatggaagaggtctacatcaacggcgacatcgaccagcgcgtgccgcacaacctcaacgtcagcttcaacttcgtcgaaggcgagagcctgatcatggccatcaaggatctggccgtgtccagcggctcggcctgcacctccgcctcgctggagccgtcctacgtgctgcgcgcgctgggacgcaacgacgagatggcgcacagctcgatccgcttcacgctgggccgcttcaccaccgaggaagagatcgacttcaccatcgccctgctgaagtccaagatcggcaagctgcgcgagctgtcgccgctgtgggagatgttcaaggacggcgtggacctgaatagcgttcaatgggcggcccactgagccgataacggattatcggccgcggcaactccaaccgccgcggcccgcaggagaaaagacatggcatatagcgaaaaggtaatggaccactacgagaacccgcgcaacgtgggttccttcgacaaaggcgacgacagcatcggcaccggcatggtcggcgcgccggcctgcggcgacgtgatgaagctgcagatcaaggtgggcgcggacggcgtgatcgaagacgccaagttcaagacctacggctgtggctccgccatcgcctcctcgtcgctggtgactgagtgggtgaagggcaagtcgctggacgaggcgctgaccatcaagaacaccgccatcgccgaagaactggcgctgccgccggtgaagatccactgctccatcctggccgaagacgcgatcaaggccgcggtggaagactataaacagaaacacggcaagtaaaccggggaacggtcatggcacttactctctccgaacgcgccgccgcccacatcagcgcctttatcgccaagcgcggcaaaggcctgggcgtgcgcctgggcgtgaaaacctccggctgctccggcatggcctacaagcttgaattcgtcgatgtcgccagcgacgacgacgtgcgcttcgacagccacggcgtctcgatcttcaccgacgccaagagcctggcctacctggacggcaccgagctggactacgccaaggaaggcctgaacgagggcttcaagttccacaaccccaacgtcaagaacgagtgcggttgcggcgagagcttcaacgtctgacccctcgcggccgggcggagcgttggcgcggcacgcgtcatcctccgccttgcgcttttgccggccgcccagccccctgcctctctggaagcctgatgaacaccgatttcagccaagacttcttcagcctgttcggcctgccgcgccgcttcgccatcgacagcgccctgctcgacaacgcctggcgcgctgccgcggcccaagtgcatcccgaccgctacgccgccagccccgatgccgagaagcgcagcgcgctgatgctgtccacccgcgtcaacgaggcttaccgcacgctgaaatcgccgctgtcgcgcgcccgctacctgctgcaactgtccggcgtggacacccaggaagagagcaataccgcaatgccgggcgacttcctgatggcccagatggagtggcgcgaagacatagacgatgcccgccgcgacctcgcccggctggaagcgctgtccagccggctgcgcgccgaagccaatgcactgcaggcggcgctggcacaggcgctggacagccgcgccgacttggacggcgccacggttctggtgcgaaaattgcgattcatggaaaagctggaccaggaaatcggcgacgccatcgaaagcctgctggactgaaaccggccgcgacgccgccctgagcaacgacacaaagaccaccacgacatggctctactgcaaatcgccgaacccggcctctccgccgctccccatcaacaccgtctggccgtgggcatagacctgggcaccaccaactcgctggtcgccaccgtaaaaagcggctccgccgtcgtgctgccggacgagcacggctgcagcctgctgccgtcggtggtgcgctacgtcgacgaaggcgaaccggaagtgggctacgaggcgcagcgcgaacaaaaccgcgatccgcacaacaccatcgtctcggtcaaacgcttcatgggccgcggcctgtccgacctgaaagacgccggcagcctgccctaccgcttcgtcgacgcccccggcatggtgcaactgcacacccgcgccggcgtgaagagcccggtggaagtgtcggccgacatcctgcgcgcgctgaaggtccgcgccgaagcgagcctcgccggcgagctgaccggcgcggtgatcaccgtgcccgcctatttcgacgacgcccagcgccaggccaccaaggacgcggcccgcctggccggcctcaacgtgttgcgcctgttgaacgaacccaccgccgccgccatcgcctacggcctggacaacggcagcgaagggacttatgtggtgtacgacttgggcggcggcacgctggacgtgtccattctcaagctcagccgcggcgtgttcgaagtgctggccaccagcggcgactccgcgctgggcggcgacgacttcgaccaccgcgtgttctgctgggtgctggaaagcgccggcctgtccggcctgtccgctcacgacatgcgcctgctgcacacccgcgcccgcgaagccaaggaagcgctgaccgaccacgccggcacccgcatcaccgcgatactgtccgacggccagacgctggatctggaactggaccaagccaccttgcacgccatcaccaaaacgctggtggacaagacgctgctgccggtgcgcaaggcgctgcgcgacgccaagatcacgcccgaagacattcaaggcgtggtgatggtgggcggcgccacccgcatgccgcacgtgcaaaaagccgtcgccgacttcttcggccgcgcgccgctgaccaatctggacccggacaaggttgtcgcgctgggcgccgccatccaggccaatgtgctggccggcaacaagcaggacgacgagtggctgctgctcgacgtgctgccgctgtcgctgggcatcgagaccatgggcggcctcaccgaaaagatcatcccgcgcaacagcaccatcccggtggcgcgcgcgcaggacttcaccaccttcaaggacggccagaccgcgatgtcgatccacgtgctgcagggcgagcgcgaactggtgtccgactgccgcagcctggccaaattcgtgctcagcggcattccgccgatggtggcgggcgctgcgcgcatccgcatcactttccaggtggacgccgacggcctcttggccgtcaccgcgcgcgagcaaacctccggcgtggaggccagcatcgaggtcaagccgtcctacggcctgtccgacgacgagatcagccgcatgctgaccgaatcgatgagccatgtgcaggaagacatcgaagcgcgcaagctgcgcgaagccatcgtcgacgccgacagcctggcggaagccacccgcaacgcgctggccgccgacggcgacctgctctccgacgccgagcgcgccgaggtggaaaccgcggtcgccgccatcgcccaggcgatcgccggcaatgtgacccgccgcatcaacgaggccaccgccgcgctcaaccacgccaccgaaaccttcgccgcccgccgcatggaccgcaatatccagcgcgcgctgaagggccacaagattaccgatttgtaaggatacgcccccatgccgcgcatcatcgtactgccccacgccgacctatgcccggaaggcgccgtgatagacaacgccgaaaccggccagagcatctgcgacgtgctgctggcccacgacatcgagatcgagcacgcctgtgagatgtcctgcgcctgcaccacctgccactgcatcgtgcgcgaaggcggcaactcgctgaacgaggccgacgaactggaagaagacttgctggacaaggcctggggcctggaagcccagtcgcgcctgtcctgccaggccatcgtcgccgacgaggacctggtgatcgagattccgcgctacaccatcaaccacgcccgcgaacatcactgagccaggagacgcgcaatgaaatggaccgacgtcaacgacatcgcaatcgagctggccgatgcccatccggaagtggacccgaaaaccgtccgcttcgtcgacctgcacaactgggtggtggagctgcccggtttcgatgacgaccacagccgcggcggagaacgcgtgctggaagccatccagcaagcctggatagacgaggcggaataatcccatcctcctgaccggccgcgagcggggctccccgccccagccatagctcgcgccggcgccttcccttcccgctcgacactcccctttccgcatcgcgcaatgcgccacagccacgccaccaacccaagtttctcctgtcagccgactcccgccccgccctccggcagcgtcagcgctcgcgctccgctcctgcgcgccgaatccgctctctaaaaaatccaaaataaatattaatttggattgaccaatgtcaaacattgtctaaaatgacaaattcatagtgacgcaagcggagaacctctgtggaaacagttgaagcattgaaattcttgtcgccggaagaaatccctcatctggcagaacgctatggcacgcctctttttgtgtacgatctggacaccatcaagagaaactacgactacttcagccaaataccggcgccgtacggccttaccgtgcgctattccgtaaaggccaatccgactcgcgccatcctggcctatttcaaccagctgggcgcctcgttcgatgtcagctcggtgtgggaagcccgccgctgcgtcaatgccggcattgatgcgagcaaaatcctgatcacggcgcaggaggtgtccgcaggctgggaagaactgtgcgaagcggggatggaattcgatgccggctcgctgcagcagctgcgcgcttacggcgagaaattcccgggcggccaggtttccctgcgcatcaatccgggctttggctccggcctggtcaagaagctcaccagcggaggcgaccactccagcttcggcctgtggtacgcccagtttgacgaagccctcgcgctggccgagcgttattccctttccatcaagcgcatccacctgcacatcggctccggccatgattccggcatcctggaaaaaacggtcaatcgcgcgctggaactatgcgcccgcgcgcctggcgtcacccatctgaacctgggcggcggctacaaggtcaccgcgctgaacagcgacccccaatacgatcaccacgcggtaggcgctcgcatcagcgcttcgctggagcagttccaccgcgaaaccggacgccaactgcatctggaaatggagcccggcaccttcgccatggcattggccggctcactgatcacccgggtcatcgacgtggtcaacaccggcggcgatggctatcgcttcatcaagattgacggcggcctcaccgaactgatgcgcccgtcttactacggcgcgctgcacccattggtcgtggtcaagaaggatggctcgctgggaacccatgacgtcactccgcagatggtctgcggccactgctgcatcgccggagacagcctgacgccggtagcgggcaatacggaagatttcacgccggtgccgctggcccgcgcggaaatcaacgactatctggtggtggaacgcaccggcggctacgccgccagcatgagcgtgaaaaatttcaactcctatccggaggccgccgaggtctgccgcgccggcaaaggcagttatcacaagattcgggaacgccagaccctggagcagatgacgcagaacgagcgcgacctgcctctggagcgttgagcccgcccagccgccaacaacccctccctttccaggcaagcgccaagcttgcctatgagccgccggcaagccaggcatcgccggcggcggggagactgttgcccggcggatccggtttcacacccgcaacttagttttgcatggcccaactcagtttcccccactccctcgcggagagttcaggttcaggaaacgctgtcactttaggagcaaatgtgagtacgacgaatacgaccgcatacgatcttctggccggcgatttggaaggcagcaccgatgtgcagctcgcgccggtcaagggccaggatttgcgccgcaacctgccgcgcgaatacttcgttaagcgccccgccctgttcaccgccaaaatcctgttcgccttcgccctgatcgccttgggctggtacggcatctggtacgcgctgaccacacccgtcaccaccgtttcgatactggcggcggttggcggctttttcctgaacggcctgatttacgcccacctgatcgagctgcagcacgaatgcctgcactgccacgccttcaagtcggtgaagctcaaccgtctgttcggcgctctcgccggcgtattcatgttcagctcccattcgcactaccgctacgaccatctgcgccaccatgcctaccttggcacggaacgcaatctggagcacttcgactaccgcttcaatgatctcaactcgctgaccggcttcgccatcgccttcttcgacttgaaccgttacaagcgcgtattcaacatcctggccgccgccctgaccggcaagccgatagccggggtcgccaaagaggaagcccaacgccacatcaagcaggagtatctgatctacgcgctggccttcattgccagcgtgatcgcctcgctgcatttccacacctggctattcgccctggcctggtggctgccgacgctgatcatcgccgaaggcgcccacttcatgatcgagatgcccgaacactacgggctgaatacccaaaccgcgcccgatgtgctggaaaacacccgcaccatccgcaccaaccccatcatcgcctggtacgtgaacggcaaccacacccacaccgcccatcactttcaccaaggcgtgcccatgtgcaacgtcaaaaagctgaacgcgctgatcaagccgcaattgcaagtcgtggaaacctcgtacttcgcgttttattgcgatgtgatccgcggacgaatcagccaccgctacgacgcgacttgcatggccagatgaggatgatggttagcgttgccgatcatgcaactcggctcaatgaatatttcttataaataactttgcccggcgcccgatgactaatgacagtcgatcgggtgctgaggtataagaagttgagttgaataattcgcaacaccctaacttgaatggaaacaggctcatgaagaaagttggtttggtcggttggcgaggcatggtcggctcggtcctgctgcaacgcatgcaggaagagaacgatttccatggcattgatcctcactttttcagcacatccaacgccggcgccgcgggtcccgccatccatggcgccacccacctgctgaaggacgccaacgatatccgatcgctggcggaaatggacatcatcatcacctgccagggcggcgactacaccaaggcaatctacccggagctcaaggccagcggctggcaaggctactggatcgacgccgcctcggcgctgcgcatggacaaagactcctgcatcatcctcgacccggtcaaccgtccgcagattgaccaagccattcaagatggcctcaaactgtttgtcggcggcaactgttcgatcacgctgagcctgatgggccttgccggcctgatcaaggccgacttgatcgaatggatgagcctgatgacctatcaatccgcctccggcgccggcgccaaacaggtccgcgagttgatcgcccagagcggctacatcagctctcgcctggagcaggaaggcctgacgaagcaggattcgattctgccgctggtcaaacgcgtctgcgaactgatctccagcccggagctcccgaccgaagcgctgggagcgccgctgatgggcagcatcatcccctggatcgacagcgatcttggcgacggcaatagccgcgaggaatggaagggcgaggtggagaccaacaagattctcggcctggcgcccggcacgattccggtcaacggcctatgcgtgcgcgtcggcgtgatccgctgccacagcgcggccatcaccatgaagttgaagcgcgaggtcaatgaacaggaattcgccgcactggtgaaggacgcgcatccgttcgtcagctacgtgcccaataacaagcagcagagcgtcacgcagctgacccctgccgcgatcagcggttcgctcaaggtgggcatcggccgctacaagaaaatgtcgcttggacaagagcctatctattcggtgctcaccgtcggcgaccagctgctgtggggcgcagcggagccgctgcgccgcatgctgaacatcctcctcggccgcgcatgatgacaaccagggcggcgcctgccgcgccgcccgcttaaggaagcattatcttcatgggatacctcgctgcttacggatggtgcctggttaccgccttttcgatgctgttgaccggcgaagtcagccagcggctgagtcctttcatcgtctgctttttcactttcgcgctggcgacagccattttcctgtcctacaacgcgcgccatctcggatccctctggcgccgcatccgcgaaaaacgcgtgcagggcccggtgctggccatcaatctgagcagcttcgccagctggggcttgatgatctacccgctcacctatctgcagcccaccttggtcgccaccatgattctcggcatcaatccgttggctaccgccctgattacccgcctgtttctcaaacagcgctcgccggacaagctggtggtcaccagcctggccctgttcgcggtgatcgttttcctttcctaccgcagttggcaaggcgaaaacagcatccctggcacgcctcaccagcaaatcgcgctctcgctgctatgctgcgtgctctccggcatcgccacttcggtcaacaacatcctgaccaaaagaatcatgtcgaatgctttcggcatcatcgatgtgatgtgcatgcgtttttacttcaccatcctgatttccggcgtcatcggtttctccagccatcaggtggcgctcaatcaggatctggcggtttccatcctgcaaaccacgctggtattcgtggtggtgccgttgatcctgctgcagatcgctttgaagaagctggatccgctgcgcgtcgccatcatctcgccgctgatgccggtgctggtggtattgatgcaactgtatggcaatatcgccgccctttccgccgccgccatcggcgccgcgctggccacctggctgctcgtatcattgggcacctattgggccatgcagaaaaactgaccgttccgaacgcctggcgccaagccaggcgactcgccagaccgcagtgtcaagacgatgcgggctcggcggccccggatgattctcttatcgtcgcaaaggatgccgtaaatgtcgaaattgtatttgaagcccaataccatcctcgaacccttgctgtggaactggcacgcatggtcgcatctgatgagcccgctgaccgcatccatgcacatcaaaaaccgccatctgcgcatcatgcagcgctttgtcgaaaccggcagcaagcctcaggtcaagaaccagaaattcgaaggcggcccagtcgtgcagctggacggctcctttgcccgcgatgtggagcgcttgctgaacaagaccctggacgaatgccaggacctgatcgcgctggcggaaggcatcgaagacgcgtcgcaaaaagtgctggagcccgccgggaaaaccctggagccgctgtacgactcgctgcagccggcagtcaagggcctgctggagctggtatacaacctcgacttccagcctggcctgaagttttacgaatcactggtgtggcaagactattactccacccagccgcaggccatcgccttctcccagatccactccgaccggcgtcctttcatcctcggcacgccggtgctgtcaaccgcggacaatctcgttctgccgctgccgttcgcctcgtccatcatcgacgacatccagcgctccacccagcacggcattgagcggcagacgctgctggaccagctgcagctcgatccctcccagctggactccttgctgcgctttttcagcaccgagccgatcgccacccgccacaagcgctacgacggcgaaggcgtgcgagtgcgctattacggccacgcctgcttgctgatcgagagcaaggacaccgccatcctgatcgacccgctgatcagttatgactacccggccgagatcgagcgcttcacttacagcgacctgccggatcagatcgactacgtgctgatcacgcatgcccaccaggaccatttctccatcgagaccttgctcaagatccgccaccgcgtgaagaacatcgtggtgccgcgcaacaaccgcggcgacctggtcgatccgtcgctgaagcgcatcctgcagcacatgggcttcgccaatgtgatcgaactggaggaaatggaccaggtgccgctgccgcatggcgaaatcaccgccataccgttcatcggcgagcacgccgaactggatatccagaccaagctggtttacaacgtccgcctgcatggccgctcctacttcgccggcgcggacttgaacaatttcgacggcgatgtctaccgccgctcgttccgcaagctgggcgagatagaagtcgtcttcatcggcatggagtgcgacggcggcccgatccactggctgtacgggccgctgatcacccgcagctatgacaaggaagccacccgcagccgcacgctgtccggctccgactgcgccaaagccagcgcgctcatcgaaagcataggcgccaagcatgcctacgtttactccatgggagaggagccctggctgaactacatcatgaacatcaattactccccggaagcgctgcaaatcatcgagtcggaccgtttcatccggcaaaaccagcagaacgggctgcactcacgccgcctgttcggcaaggacgagtggctgttctcctgacggcctcacctgccacggcggcccgccgggcccggtcgggcctggctcgctgacggacgctttgcgcggccgcgacggaaacgcttccgcacttccacaaaacaataaggagttgcccatgcctcaacgcaacaaactcgtcattatcgtggatgcctatggccccgcccgccacttccgccactacttgcagcagcagggctatctgtgcgcgcacctgctcggcaccccccaaccgctgccgcggctgaagctcaccgagctggatcgttacgatgcggccttgatccatcacggcgacctcgccgccaccgcgcggcgcatcgaggagctggcgcaggaactggatgcggaactgcaggagattctgccgggcgtggagcccggagtgctgctggcggaccagctcagccatcgcttccagttgcgcagcaacggcatcgcgaaaagcctggcgcggcgcgacaaatcggtcatggcggatgtcctgtccgccgccggcgtcaaggtgccatcgtattgccgcaccgccagcctagacgaggcgctggcgttttcccgcggccagcaatggccgctggtgctcaaaccgctggacagcgcaggcaccaacggggtgttcttctgccattccgaacaggaactggcccacgccttcgatcaagtgatgggcgccgagaacaatatgggcctgatcaaccaggcggtcttggtgcaaagcttcctgcaaggcaaggagtacatggtcaacaccgtcagccgcgacggccggcacctgataacggatatctggtttgccgaaaagacccggatctccggctatgcctacatctacgacaaaaaccacttgatcgacagcggctcggcagaatacgcgctgctgcgcgactacgtcttcacggtgctggacgcgctggatatccgctatggccccgcccacgccgaggtcatcatcacgccggacgggccggtgctggtggaagtggcttcccgcatcagcggcggcgtcgatccggaattcaaccagctttgcctgagccatgaccagatcacgctgaccctggaaagctatctgcggccggacgccttcctgcagcgcatcggccagcgctaccagatccgcaagcatgggctgcagctgttcctgtcgtccagccaggccggcgtcgtgacggcattcgacttcccggaacatttgtcgcggatcgccagcgtggtgaactacaacctgaaacccaaggtaggcgatacgctggcgaaaacgatagatctgagcagctcgctgggcatcgtccacctcgccgcggacgaccaggccacgctgcaggccgactaccagcacattcagcatctgctcgcgcggcatctgcagtttgcctaggcgatgatctggcgcaaggggccgcccggcgcgcctcttgctcccgcccgggaattggcgtcaaatggccggatagccctgcggaggtggacatgttcacgctggtcataggcaacaagaacttctcgccctggtcgctgcgcccctggctggtgctgaaaatgctggacgaaccgttcaaggaacagcagatcgatctttacctatccgacagcaaggcccgcattctcgccgccaaccccgccggcaaggtgccggtgctggtcgacgacaagctgcgggtctgggactcgctggcgatctgcgaatacctggcagagtgtttccccgccgccggcttatggccggacgatagcaagctgcgcgccgtcgcccggtccatcatggcggaaatccactccggattcgccgctttgcggcattccttgtcgatggacatctcgctcaggcaaatagactacgaaacttcgcccgcggtggaatcggacatcgcgcgcgtcgtgtcgctctgggaagagcatagacagcggcatgtggctgacggcgaattcctgttcggccgcttttccatcgccgacgcgtttttcgcgccgatctgcacctgcttcgaaacctacaacgtcaagctgccgccggtatcgcaggcctacgtccgccatatcctgtcgctgcccgccatgcaggaatggtatcgggctgcccgccaggaaaggcagcggcaagcttagtcaattctgtcgcaaatcgagtggaacaacgcgccataagtcattagaatggcgcgttttttattttttcattacaccgaggaatccgacatgagcacccccttcatcattggcgtggccggaggcagcggcagcggcaaaaccacggttaccaacaaggtgctggaaaccattggttccgagatggcggcggtgatcatccaggattactactatcgcgaccagagccacctgaccttcgaacaacggctcggcaccaactacgaccatccgcaagccttcgactggccgctcttgatctcgcacatcgacgatctgcgcaacggccgcgccatcgagatgccggtgtacgacttcgccaaccacacccgctccgaccagaccatcaccgtgcagccggcgccggtgatcgtgatcgaaggcttgttcccgctgtacgacgccgcgctgcgcgaaatgatgtcgctgaagatcttcgtcgacaccgattccgacgtgcgcttcatccgccgcctgaaacgcgacatcgccgagcgcggccgcaccatggaaaacgtgatcgagcaatacctgtctaccgtgcgcccgatgcacaaccagttcatcgagccgaccaagcgcttcgccgacgtgatcctgccgcacggcgccaatgatccggcggtggacatcatcaccaccaaggtcgccagcctgatggtgtgacggccccgcgcgccaagccatgaagccgcccaagggcggctttttgcttgcccgattgacgccgcgggccgcgcaggcggacaatcgccgctcgcgccatccggcgcttccacaccgagacaaacatgcacaccatcaaaccgcgcaatccgctggcttgcgccgccatcctgaaaaagggcggcgcccacggccgcagccgctccggccagcgccaatcgcaaaaacaggcgctatgggccgaactggatcaagactggaatctggaagccgatcttccgccatcgccgctcgcggctcgcgccggccaagacgccgacgaggctttttcgccgcgccaagccccaaaagaaacaggccatcgcaagatggcctgtttcttttgggcgcatgccgcctgacaatccggcacacttcgtttacacagaatcacacgccgcgccggtaaaatgcggcatcgcctcattcaagatggacataccgccatgaaatggatcgccaccaccctgctgatgttgctgctggccggctgcggctcgctgggcctgaagaagccgcaagtcggcctcagcaatatcgaacccggcaacagcacgctattcgaacagaacttcaccgtaaccctgcgcatccgcaaccccaatccgataccgctcagcgccagcgggctgaatttcgaacttatgctgggcggcgaaaaactgggcggcggcgccagcaaccaggccttcagcgtgccggcccagggcgagagcctggtgccgctgcaggttcacacctcgctggccgcctggatccgtcagctcgccaactggcaaaagctgcccgacggcaagctggattaccaaatccgcggcgagctgcaaggcctgaacggcctggccaccctgcccttcgacaacaagggcgaatggaagctgccagcccggggccgctaaacctcactggcgcggcaacgccacgcagtcgttgccgtcgaagctgacgctcagcacttcctgggttttcttgtccaccacgaaattggtggtgcacttgtagtgaatggtgccgccgccgctgacgccgtcgctgacccaacggcccggggtttccaccaccttggtctggccgttgctgtcggtcacgctcagcttggtgccgggctcgtagcgggtgttctgggtcagcggctgctgctgggtgctttccttgacataggcatacagcgtgttgccgttgggcatcttcaggctgttgctgggcgcgccccactcggccagcagttcgttgacgtcgcggccttgccagcggtacaccttttgcgcatagccctgctgggtgggaatcatcgagcagccggccgccagcaaagccagcagcggtaagcacagcttcttcatcgtttgcctcgtctgattagcagattcggccattgtcacgtctgttgcgcgaaaacgccagcgccggcaatccgccatcgctgccgccggcgtcgacggcgccgcccaaaaccaaaccccgcgcctgacggcagcggggttgggcaagacatcggcaagcgcttacagcttgaagcggctgaaggcctcctgcatgctgcgcgccacgccgtccagggttttcagcgtctgctgcgcgctttgcagcgcggcgtcggaatccagaatcttgttgttgatggattcggtgctctgcgccatcgcggtggtggcgttatgctgctcgccggtggacagcgccacgtcgccgatcttctccaccacctgccgcatcgcgcgggtgatgtccaccagccgctctcgcgccgcctcggtctgcgcggcgctgctgtccaccgcgccgatggtgctgttcatattgcccaccgccttgccggtttcggacaggatgttttccaccatcttgccgatctccaccgtcgccgaaccggtgcgctcggccagcttgcgcacttcgtcggccaccaccgcgaagccgcggccctgctcgccggcgcgcgccgcttcgatcgccgcgttcaaggctagcagattggtctggtcggcgatgtcgctgatcacgccggtgatcttggagatctcctgcgagcgttgctccagcgacgcgagcaagccggatagttcgcccaccgactggctggtgcgcgccatcgcgccgctgatgcgctgcagctcctcggcgctggcctgggagttggcgccggtgtcgcgcgccagttcgtcggtttcgcgggtggcgtcggcgatgtgcgagatgctcaccgtcacctgctcgatcgccgccgcgttggagctggaaatgtcggccagcgtgtgggaatcctcagccagccgctccacgtcgccgccgaccgcgatcacgccgtcggccagctgcaccgcctcgctgcgcaattcgcggaacaggcggttcaggcggccgacgaactggttgaaggcttcggccatttgcgccacttcgtcgtcgccggccgcttcgatgcggcgggtcaggtcgccttcgccctgggcgatctcgcgcaaggcgtcgcgcacctgcagcaggcccttgagcaggcggcgcagataggcgcctgccagcagctgggtcagcgccagcaccgccagcagcgccagcagcatgtccaccatcatctggcgcagcggcgcgtccagcaattcgcggtccaccaccacgcccagcacccagtcgctgccggccaccgagctgaggcgcagcaaccggctgctcccctccagctcgaccgtcgccagttgctgcttgtccagcaggctgccgatgcggtcggcgtccatgccgggcatcaggtcggacagcggcttgagcgcggtgtcggccttcgggtaggcgatcagcttgccatccttgcccatcaggaacacgaagccgttgcccggcagcgataccgacagcaccgacttcaccaactggccgatggcgatgtcgccgccgaccaccttgttgccgcccggcagcgcctgggcgatggtgatcaccagatccttgatcgacgcgctggccggctggtaaggcgcggtgacgatggtctggccgctggccttggccatcttgaaccagccgcgtgaagcgggatcgtactccggcgtcggcttttgcttgccgggaatggagtagaccatgcccttggtgtcgccgtcgccgacgaagagctgggtgtagccgccggcctcggccagctgctgcagatagagagtgggatcggcttcgttgccgtggcgcaaggcgctggagatgatctgccggcgctgttccagccaggccgacacgaagcgctgctggccggtgatggccaggtccagttgggtatccacgctgtcggacaggctgtcgcggaatttgtaataggcgctgacggcggtgctgcaggtagccaccaggatggccagcgccagcagcagggcgatcttgctacggatggatttcatggcaatcagcttctcatcgactgttgccaacccgctgcgcgcgaaacagggccggtgcgccaggcccttttcgcagcaaaccgcccacgcatcgctgggggccaagtccatgcctggagcttgatagactgtcgtttggcgagttggcgtttttagaccgggggattgtaaacaacgcttacaaataccgcgatagattaaaacacaaatactcgaacagcctgattgtcataccaataatagtgacccgacatggcattttcgccacaccggccgcagccggcgcggcaaatccgcctgcctggtctttatagcttgaagcggccaaacgcgccctgcatgctgcgcgccagctgattcaacgcttccagcgtctgcatcgcgccttgcagcgccgagtcggaatccagtatctggttattgatggattcggtgctttgcgccatcgcggtggtggcgttgtgctgctcgctggtggacaaggcgacgtcgccgatcttgtctatcacctgctgcatcgcgtcgctgatggcgatcaggcggccgcgcgcctggctggtcaggtccacgctggtatccactgccgacacggtgcgctgcatattgcccaccgccttgccggtttcggacagaatgttctccaccatttggctgatttccaccgtcgccttgccggtgcgctcggccaacttgcgcacctcgtcggccaccaccgcgaagccgcggccctgctcgccggcgcgcgccgcttcgatcgccgcgttcaaggccagcagattggtctggtcggcgatgtcgctgatcacattggtgattttggatatctcctgcgaacgctgctccagcgacgccagcaggccggacagctcgcccaccgcctggctggtctgctccatttcgctgctgatgcgctgcatgtcgccggcgctctcgcgcgaatgctcgccggtgttgcgcgccagcgtgtcggtttcgcgcgtcgcttcggcgatgtgcgagatgctgacggtcacttcctcgatcgccgcggcattggagctggagatgtcggccagccggtgcgaatcgttggccacctgcttcaccgcgccgcccacttcgatcacgccgtgcgccagttgctcggcctcgccgcgcagttcgcggaacatgccgttgaggcggccgacgaactggttgaaggcctcggcggtctgcgccacttcgtcttcgccatgcacctcgatgcggcgggtcaggtcgccttcgccctgcgagatttcacgcatcgcgtcgcgcacctggatcaggccgcgcagcaggcgggtcaggtagccggagctcagcgccaccagcaccagcagcaccaccgccacgccgccggcgatcagccagatcagttgggtcaccggcgccagcaccgcgtcttcgtcggcggccacgcccagcacccaatcggtgccttccacctggcgcaggtccaccaggaaggtcttgccatcgatctccatcggcgtcacatcgccgctggccaccaattgctggaagcggttgtcgtccagcgccgggatcagctcgctcaccggcttcaactcctggcccggcttcggataggcgatcaccttgccctggcgggtcagcaggaaggcatggccgtcgccggccagcttgatgtccagcaccgacttcaccagcttgtcgatcaggatgtcgccgccgaccacgatctcctggccctgcgccttgtcggcgatggtgatcaccagcttgtccttggtttccggctcggaatccttatacggatcggtgacgatcagcccgccctgcgccttggcctgctgataccaggggcgctgcgccggctgatagtcggcgctcggcttcacccggcccggcacagagtagaacatctcgccgctgtcgccatggccggcgtagatgatgttgaagccgccgcccttggcgatctgttgcagatagtagctggcctgcggatcgccggccttcgacaggctggcgctgatcaggcttttgcgcacgcccagccattccgataccagtccgccctgcagttgcagcacctgggtgacttcgcgcttggcttcgtcgtaagcgtggttgcggatattcaggcaggcgatgatggcgacgcttagggtggcgaccaggatggaaaccgccgtcagcaagatgagcttgtgtcggatggagcgcataagatgattagccgatgctgataaaagggctattatccgtcatagccaacaacatgcatcgttaaaaataacattatatttaaataatattgcggtctttaaatcaaattactcagaaaatatcgccgaatgattgctgccagcgctcggccagccgcgcggattgatcccgcaccagcgcgttgaagaagttttgcagcggatcggcattgcggcgcggatgccacaagtgctcgatgccgatctgcaattcggcgtcggccagccgctgcgcggccaggccgttgtctcccctgcgcaacaccccggcgatcaggtccggcagcaccgccaccgccggcagctgcgccaggacggccggaatcgccaacaggctggcggtggaggcgatcacccgccgcttcagcccctgcccgctcagataatcatccaccaagctggcgctgtcgccggcgtaggaagtatggatgtgcggcggccgcgccaagtcttcggcccgcagcgtctgcggcatccggatttgcgcggcgtggtagaaacagacgaagcggctgacgaacagcgcctgccggcccagccgcgcggaggcatgcggaaaatagcctatcgcgccgtctatccgcctccgctccagcgcgtcttccacctcgccggccggcatcgccaccacttgcaggctcaatcccggcgcctgcgcctgcagggcgacgatcagcgccggcagcaaggccgcctccagcaaatcgggcatcgccagccggtattcggcccgcagcgcggccggatcgaaaacctgcggccgcaacagccgctgcccctgctccagccaagcctccagcggcggcagcaaggcctccgccagcggcgtcagctccatgcgccggccatgtcggcacaacagttcgtcgccggtcagcgcgcgcagacgcttgaggatgtggctgaccgccggctggcccaggcatagccgctcggcgctttggctgacgctgcgggtactgagcagcgcatgcagcgccaccaggctgttcaggtccagcttgcgcagctggaccgcatcaatattattcacagtaatattttagatgaaaaacatcgattttattaaataaatcgggctttctacactgggcgcatccccatcgccggattcgccttcatgtcccaagccccctccgcccgcccgctgccgcggctgctcgccatcatgctgatcgcctggctggaattcctgcagaacggcatgctcaatttcgcctcctcccacgtgatgggcggcgtcggcgccgggccggaggagttcagcctggcggccatggcttacgcgctgtgcgcggtggtggcgctgttcaaccaccaatggtgcgtcgagcgcttgggctcgcgccgccatctgcaaatctccctgctgctgttcggcctgggcgcgctcctggccgccaatgcccagactccggccgccttcatcgccgggcgggcagtgcagggcctgggcggcgcggccttcttcaccgccgccaggctggaggctgcccagctgcccccggcctggcgcgcggccgggctggtggccttcggccaggcgctattgctcggctcggcgctggggccgctgctgggcggcatgatattgcgcgccggcagctggcgcggcatcttctgggccatcctgccctgcctgccggccgcctggtgggcggcgcggcaactgcccctgcgcccgccggcgccgcaagcgccgcgctatcaccccgcggctttcatctggctggtggctgcggcctttctgctgcagtggctgatccagcaactgccctaccagctgttcggccatccgcaatggctgctgggtttgctggcggccgcgctggcttgctgcgccgccctgcgcctgcgccatcccggcggcgccagcgaccgcgagcgctggcgggcgctgaagcagccgggctacctgctgggtctgttttgctacgcctgctgctacctgctggtttcggccaatagctacatcctgccggcggtggccatccaggcgctgggcttcgacgtgccgaccagcggcgcgctgctggccgtcagcttcttcgccggcatggccgcgtccctgctgtacgccgtcctgctgcgctcgcgccgcccgcccagcctcgccgccgccatgctgtgcggctgcctgttgctggcgctgtacggctggcggatgagcgcgctgaacgccgaagccagccagctgcggctgacattgacgctgctgctcaacggcggcttcatgtcgctgttcatcatggccaccgcgcaacgcgcgttccgcgacatcgcgccggccgccttcggccacgcgtatcaaaccaagaacatcgtgcgccaggtgtccatctccgccggcgtggcgctggccaccgtgttcctgcaggcgcgcaacgcgctgcactacagccggctgggcgagaatttttcttggaatacgccacagtttgtcgaggttttgcatcaaatgcgacaattgatgcccgaattgagcgatactcaacgcttgggagtgctggccggcgaactcgcccggcaggccacgctgctgtcctgcctggactttttccggctggaaagcggcatcgcgctgggcctggccgctgccatcgcctgcctgcgcaagcggatgtgagcgccggctcccgactgtgtccgtgtcatcaggaagaatcatcatgcgtaaaagcggcagccaatcgccgacctttgacaagatcatcgaagccagcctgcagctgttcaaccaggagggcgagcgggtgatcaccaccaaccacatcgccgagcggatgaacatcagcaccggcaagctctactaccacttccgcaacaaggaagagatagtcaatgagctgtaccagcgctacgtgaaaggcatgggtgaacaactgtccgccgccatcaaccattgcaactcgatagaggcgatggtgggcgcgatggaaaagacgctgcgccacatctggagcttccgcttcctgccgcaaagcctgcccagcctgttttgcgtcaacccgacgctggccgagaaccaccagcagatttcgcgtggccagctcagcgacaagctggcccagctgttcgcccgcctgcgcgaacagggcatgctgcaaggcgacgacagccagctgcagcacctggtccagcatttccagatggtgcagaccggctggatcaacaccatcaagcagaacgccagcccggccgagctggaaaaactgatccagtccggctgccgcagcctgatgtatctgctgacgccctacgtcagcccgcgcttccagtcgccgttcgagcgcgcctgcgcgcgcttcgcctgatacgcctgcgtccccgcgggcatcgcctttggcgtacccgcgcgctgcgaggcgctaaataaaaaaacaccccgcgatcgctcgcggggtgttttcgctcaggccaggaaaaccgggcttagatcatgcctttgcttttcagcagttcgaacatggttttgccgatttcggccgggctgcgggtgtaggcgatgccggccttctcgaaagccttgaacttctcttccgccgtgcccttgccgccggagatgatggcgccggcgtggcccatgcgcttgcccttcggcgcggtgacgccggcgatgtagccgactaccggcttggtcacgtaggacttggcgaactcggccgcttcttcctcggcggaaccgccgatttcgccgatcatcacgatggcgtcggtgtccggatcatcctggaacaggcgcaaggcgtcgatgtggctggtgcccgggatcgggtcgccgccgatgccgatgcaggtggactggcccaggcccagcgcggtggtttgcgccacggcttcgtaggtcagggtgccggagcgggacacgatgccgatgcggcccgggttgtggatgtgccacggcatgatgccgatcttgcactcgcccggggtgatgatgccggggcagttcgggccgatcaggcggatgccggcttcgtcgacggccttcttcacgtacagcatgtccagagtcggcacgccttcggtgatgcagacgatcagcttcacgccgctgtcgatggcttccaggatggaatccttggcgaaggctgcgggcacgtagatcaccgaggcgtcggcctgggtctgacgcacggcgtccttcatggtgttgaacaccggcaggcccaggtgctcggaaccgcccttgcccggggtcacgccgcctacgaccttggtgccgaccttcagcgcctgttcggcgtggaaggtgccgttcttgccggtgaagccttgcaccagcactttggtgtctttgtttaccaatacgctcattttgtattcctcagctcagtgcgggtctcaggccacggccttgacggcggcgacgatcttctcggcagcgtcgttcagaccctgggcggaagtcagtttcaggccggattcgtccaggatcttggcgcccagctcggcgttgttgccttccagacgcaccaccaccggcacggtcacgttcacttccttcacggcggcgatgatcgcttcggcgatcatgtcgcagcggacgatgccgccgaagatgttgatcagcacgccttgcaccgaggtgtcggccaggatcagcttgaacgcttcgatcacgcgctctttggtggcgccgccgcccacgtccaggaagttggccggctggccgcccttcagcttgatgatgtccatggtggccatcgccaggccggcgccgttcaccatgcagccgatattgccttccagggccacgtagttcaggtcgaactcggaagccttcacttcgcgctcgttctcctggctcttgtcgcgctgggccagcagttccgggtggcggtacagggcgttggagtccaggttgatcttgccgtccacgcaggccagctcgccgttttcgcgcagcgccagcgggttcacttcgaacagggcgaagtcgttttcgacgaaggcctggtaggagcccagcatcagcttggagaacgcggcgacttgcgcgccggacaggcccagcgcgaacgcggcgtcgcgcgcctggaacggctgcatgccgaccagcgggtccacttcgatcttgatgatcttttccggggtttcttcagccaccttctcgatttccacgccgccttcggtggaaaccatgaacacgacgcgctggctgccgcggtccaccacggcgcccaggtacagttcgcgctgcaccgggtacatgtcttcgcagaccagaacgctgttcaccggctggccggcggcgtcggtctggtaggtcaccaggttggtgccgatcagggtcttggcgacttcggcggcttcttcgcggctcttcaccactttgacgccaccggccttgccgcggccgccggcgtgcacctgggccttgacgacggcgaatttgccgcccagcttgtcgtaagcggcagccgcttcttccggcgacttggccagaatgccttgttgcaccggcaggccgtaacggctcagcagctctttcgcttggtattcatgcaggttcatctatggtttcctttattggaaatcagacggggacacgccccatcctaatctgcttccgccgcatttgcggcagccatcactttgcgggaacacgttttaccatcttgtcagtccccataacaagagaactccgacaagcgccacccccagtggcatcggcaggcggctcctggccttctctgaacagatgaatactgaacagggaaaaccaagcgccgccacaagcagcacaaccccatgcaatccatccagcgcgccagcttcgtcaaaggcgatcttcaccgcccacagtagcgagcccaccatcagcaatatcgcgatgatagccagatgcatggtcagggtcatgccgagttcccgcgcaacttagccgtgcaacgcgcgcttgtcggcggcgagcgcggcttcgtggatcacttcggacaacgacgggtgggcgtggacgatgcgcgccaagtcttcgctggcggccttgaactccatcgacaccacgccttcgctgaccagctcggacaccatcgggccgatcatgtgcaggcccaggatgcggtcggtcttggcgcaagccaggatcttcaccgtgccttgcgcctggcccaggcccagcgcgcggccgttggcgccgaagccggaggtgcccttcttgtactcgacgccctcggccttcagctgctcttcggtcttgccgacccaggcgatttccggcgaggtgtagatcacccacggaatcacgccgaaatcgacatgcggcttctggccggcgatgcgctcggccacggccacgccctcttccgacgccttgtgcgccagcatcgggccgcgcaccacgtcgccgatcgcccagacattgggcagattggtgtggcagtgctcgtccaccgcgacgaagccgcgctcgtccagttgcaggccaacagtctcggcgcccaggccctgggtgttcggcacgcggccgatggagacgatcagcttgtcgaactcggccttcaccgcttcgccgttcaattcgtaattgacggtgacgctcttcttgccagccttcacttcgccgatcttcacgcccagcttgatgtcgaggcccgtatctttagtcagcgtcttgaaggcttccttggcgatctgctggtcggcggccgccaggaaggtcggcatcgcttccagaatggtcacctcagcgcctaaacgcttccagacagagcccatttccaggccgatcacgccggcgccgatcacgcccaggcgcttcggcacggcggagagcgccagcgcgccctcgttgtccagcaccagctggttgtcggtggccaggcccggcagcgcgcgcgggctggagccggtggccacgatcacgtggccggcttccagcgtgtccaccaccgcgccgttgtcggtgacttcgatcacccacttgtcgccctggcggcccttgaaggcggccaggccgtggatgttggcgaccttgttcttcttgaacaggaagctgatgcccgaagcgttcttggtgatgatgtcggtcttgcgggccagcatctggccgacgtccatcttggcgccggacacgctgatgccgtgcttggcgaaatcatgctgcaccgcgtggaagttttccgacgactgcagcagcgccttggacggaatgcagcctacgttcaggcaggtgccgcccaagctgggcttgccttccgggtttttgaacgcgtctacgcaggcggcgctgaagcccagctgggccgcgcggatggcggcaacgtaaccgcctgggccgccgccgatcactaccacatcaaactgttggctcatggtattcccttgggatcaggccttgccgactttgaacagcaaggccccgaaagcgatcatgaacagcgcgatgacgatcttgcccacccggctgtagctgtcctcacgcacgccgcgctgatgcttcttccaggtcaggaagagcagcaccacgccggccagcaccgaggccacgccgtaaaaccagtcaggcagattcattctcgctccgttcttgcagattcagacaggccggctcgcgccggcccttgtcgttacaggtcgaggatcaggcgggccggatcttcgatggcgtccttgatcgccaccagggacagcaccgcttcgcggccgtcgatgatgcggtggtcgtaggactgggcaagatacatcatcgggcgcaccacgacttgaccgttctcaaccacggcgcgctccttggtggcgtgcatgcccaggatcgccgattgcggcgggttgatgatcggggtggacatcatcgaaccgaaggtgccgccgttggagatggtgtaggtgccgccggtcagctcttccacggtcagcttgccttcctgggcgcgcttgccgaagtcggcgatctgcttctcgatgtccgccaggctcagctggtcggcattgcggatcaccggcaccaccaggccgcgcgggctgcctaccgccacgccgatgtcgaagtagccgtggtagatgatgttgttgccgtcgacggaggcgttgacgatcgggtacttcttcaacgccgaaaccacagccttgacgaagaagcccatgaagcccagcttgatgccgtgctctttctcgaacttgtccttgtacttgttgcgcaggtccatcaccggcttcatgttcacttcattgaaggtggtgaggatggcgttggtctgctggctcatcaccaggcgctcggccacgcgctggcgcaggcgcgacatcggcacgctctgctccggacggccggacaggatgccggcgatgttgacggcggccggggtcgacgacagcgccgcgccggaggacaccgggccggcttgcgacggggcggccggcttggcggcggcttgcacgtcttccttcaggatgcggccgtcgcggccggaaccggcgacattcgccaggttcacgccggtttcggcggccagcttggcggcggacggcatggcggcggcgcctgccgccggcgcggcggccggggcttgaaccggagccggcgcggctgccggagcggcggctgccggggcaggagcggcgtcgccggcttgggctgcggtgtcgatcttggcgatcagctggccggacaccacggtggcgccgtcctgctcgatgatctcaaccagcacgccggcttgcggggccggcagctccagcaccaccttgtcggtttccaggtcgatcaggttttcgtcgcgcttgacgaattcgccgacctttttgtgccagctcatcagcgtggcttcggatacggattccggcagttgcgggactttgacttcaatcagcatgttcttctccatggcgggacggcggccggccgtccctgactttctcgtaggctcagcgggcgaccgacatcgcttcttcgacgaaggctttcagctgggcgacgtgcttgctcatataaccgaccgccggcgacgccgacgacgggcgaccggcgaacgacagttgctgcttggcggacaacaggccttccaggcggtggcggatctggtaccaagcgccctggttgcgcggctcttcctgcacccacatcacttccttggcctgggtgtagcgcgccagctcggcggccacctgctcggtcgggaacgggtacagctgctcgatgcggacgatggcgatctcatcttccagaccgcgttccttgcggccggcggcgaggtcgtaatatacctggccggcgcacagcaccacgcgcttgaccttcttcggatccttgacgatggcgtcgccgatcaccgggcggaagctgccgctggtcaggtcttcgatcgggctcatcgaatccttgaagcgcagcaggcgcttggacaggaagatcaccagcggcttgcggtacgggcgcagcacctggcggcgcagcatgtggaacatctggccggcttcggacggcatcaccacttgcatattgtgctcggcgcacagttgcagccagcgctccaggcgggcggaggagtgctccgggccctggccatcgtagccgtgcggcaggatggtggtcaggccgcacagacggccccacttggtctcgccggaagagatgaactggtcgatggccacctgggcgccgttggcgaagtcgccgaactgggcttcccagatcaccagctggtcgggagcggaacaggcgtagccgtattcgtaggccagcaccgcttcctcgttcaggatggagtcgatcaccaggaaatcggcctggttgtcggacatattgcgcagcggcacataggcgccctggtcccagcgctcgcggttctggtcgtgcagcaccgcgtggcggtggctgaaggtgccgcggccggagtcttcgccggagatgcgcacgccgaagccgttggtcaccaggctggcgtaggccagcgtctctgccatgccccagtcgacattctgctcgccggcggccatcgccttgcgcgcggccagcactttctgcacggtcgggtgcagcttgaagccttccggcagcgaggtgaacttgtcggtcaggcgctggatgtcggcctgcggcagcgaggtgtcggtcgggtgcgcccagtgggtgcccaggtactggctgaagtccagcgcgtgttcgcggcggtagttggtcagcgcggtctgttcgacatgctcgcccttgtccagcgcgtcgcggtaggcctggatctgcgcgtcgccttcttccgccttcagcacgccctcctgcaccaggcgctcggcgtacatcgcgcgcacgccctggtgcttggcgatcttcttgtacatcatcggctgggtcaggaagggatcgtcgccttcgttgtggccgagcttgcggtagcacaccaggtcgatcaccacgtccttcttgaaggtcatgcggtaatccagcgcggcctgcatcacgtagcagacggcttccggatcatcgccgttcacgtgcaggatcggcgcttcgatcatcttggccacgtcggtgcagtacatcgtcgagcggatgtcgcgggtgtccgaagtggtgaagcccacctggttgttgatgacgatgtggatggtgccgccggtgccgtagccgcgggtctgcgacaggttgaaggtgccttggttgacgcccaggccgccgaaggcggagtcgccgtggatcagcaccggaacagcggtcttgcgttccgcgtccttgcggcgctcctggcgcgcgcgcaccgagccctccaccaccgggttgacgatttccaggtgcgacgggttgaacgccagcgacacgtgcatcgggccattggcggtcgggatgtcggacgagaagcccatgtggtacttcacgtcgccggaagccatctgctgggcggccttgccttcgaattcggcgaacaggtcgcgcggctgcttgcccagggtgttgaccagcacgttcaggcggccgcggtgggccatgccgatgatcagttcctgcacgccttgcgcggtggcgttctggatcaggtggtccagcgccgcgatcgcggattcgccgccttccagcgagaagcgcttctgaccgacgtacttggtgtgcaggtagcgttccagcgtttccgccgcggtgatctgcttcaggatgcgctgcttcttggccgcgtcgtagcgcggggtggacaggtcgccctcgaagcgcttctgcacccagtgtttttcatcggactgggtgatgtgcatgaactcgacgccgatattgccgcagtaggtctgcttcaggcgcgccaggatgtcggacagcggcagcttctgcgggcccaccagcgagccgacgttgaactgcaccgccatgtcggcgtcggtcaggccgtgggtggccggatccagttcgcgcagcgtctgctggtccatccgcttcagcgggtcgaggttggcctggcgcgagcccagcacgcggtaggccgagatcagcttgagcacgcccacctgcttctgcatcgcgtcccagtcggcggcggcgctgctgcgctggccggacagcggcttcttggccagctggatgaacgactcctggatcggctggtgcggcacgtcgcgctcggcggcgcccggcgcctgcgccagcttgtcgaagtagtcgcgccactcgttcggaaccgaattggcgtcagcgaggtactgttcgtacagctcctcgatgaacggtgcattcccaccgaacaggtaagaatggctgtacatggattgcatcatgatctggctaccctttgtctttacgttgcagcattcactcaaagcgcttgggcaaggcggccttgccccagcgctctgtaaaaaagggctggctgaagcccccgcttcaaccaaccctggtgtttcacatcagcgcttcgccacttccacgaagtcgcggcgcggagcgccggtgtacagctggcgcggacggccgatcttcatgcccgggtcgccgatcatctcgttccagtgcgcgatccagcccacggtgcgggccagcgcgaagatcggggtgaacatcgaaaccgggatgccgatcgcggacagcacgatgccggagtagaagtccacgttcgggtacagcttgcgctcgatgaagtacgggtcgttcagggcgatcttttccagctccatcgccagcttgaacttcgggctgtcgcccaggcccagttccttcaacacttcgtcgcaggtctgcttcatgatggcggcgcgcgggtccatgttcttgtacacgcggtggccgaagcccatcagcttgtagcgcttgtccttcacgccctgcatgaagtcggccacattgtccaccgagccgatctcgtccagcatcttcagcacggcttcgttggcgccgccatgcgacgggccccacaggcaggcgatgccggcggcgatacatgcgaacgggttcgcgccggaggagccggccagacgcacggtggaggtggaggcgttctgctcgtggtcggcgtgcagggtgaagatgcggtccatcgcgcgggccagcaccgggttcaccttgtactcttcgcacggggtggagaacatcatgtgcaggaagttttccgcgtagttcaggccgtttttcgggtaggagaacggcaggcccttgttgtagcggtaggcttgggcggcgatggtcggcagcttggccaccaggcggtgggccgagatgcggcggtgttccggattggagatgtccagcgagtcatggtagaacgcggacagcgcgcccaccacgcccaccatcacggccatcggatgcgcgtcgcggcggaagcccttgaacaggctcatcagctggtcgtgcagcatgttgtggcgcatcacgccgcgttcgaattccttgcgctgcgccgcggtcggcaactcgccgttcagcagcaggtagcacacttccagatagtcgctcttctcggccagctgctcgatcgggtagccgcggtagtacagatggccgaggtcgccgtcgatgaaggtgatgccggattcgcagctggcggtggcgaggaagcccgggtcgaacgtgaacatcccggtcttgccgaaagagcggatgtctacgacgtccggacccagcgagccccccaggaccggcaggtcgatggagtccttaccctcgttgtagctgagcgtgactttgcgattagtttccacagcaatactcccagtcggtttatatcgttgttgttggagtggtttcggccttacagcgatcggaggatcgccacaatggccatctcttccggatcctcgagatcggccttgccgctgacgatatccagaaaatcggtgtcggccagatccagcagacggcggtaggcctcgatctcggccggggccagccgcccgaacggcccggccaggaatttctccagcaccaggtccagttcgagcaggccgcggcgcgagcgccagcgcatccgcttcagttctatcggatcgtaagtcgtcataccgcgcgcttgaccatcaggtccttgatcttgccgatcgccttggtcgggttaaggcccttcgggcagacgtcgacgcagttcatgatggtgtggcaacggaacaggcggtacgggtcctccagattgtccagacgctcgctggtggcttcgtcgcgggtatcggcgatgaagcggtaggcggccaacaggccggccgggccgacgaacttgtccgggttccaccagaacgacgggcaggacgtcgagcagcacgcgcacaggatgcactcgtacaggccgtccagctccttgcggtcctccggcgactggcggcgctcgcgttccggcggcggcgtgtcgttgatcacgtacggtttgatcgagtggtactgcttgaagaactgcgccatgtccacgatcaggtcgcgcaccaccggcaggcccggcaacggacgcagctcgatcggctgcttcaggccgcggaagtcggtgacgcaggccaggccgttcttgccgttgatgttcatcgcgtcggagccgcagacgccttcgcgacaggaacggcggaagctcagcgtgtcgtccttgatcttcagcttgaccagcgcgtccaagagcttgtgctcggtggcgtccatctccacgctgatgtcctgcatgtacggcttggcatcctggtccgggttgtagcggtagatgcggaatttgatggtttcggtagtcatctctggttcaacccttagtaggtgcgggccttcagcttgatcgtgtccacggtcagcggctgcatgttcaccggcttgtactccaggcggttgccgtcgcggaaccacagcgtgtgcttcagccagttgacgtcgtcgcggccgttcggggtggcctcggtgtccagcgcgtcgtcgcggacgtgggcgccgcggctttcggtgcgggcattggcggaaaccatggtggccttagccacttcgatcaggttctccaactccagcgcctcgatgcgggcggtgttgaacaccttggacttgtcgccgatttcggtcttggcgaccatgtcggccacttccaggatcttttccacgccttcggccagcatgtccttgaagcggaacacgccgcagtgggcctgcatggtgcgctgcagcgcggcgcgagcctcgtgcacctgcacgccgttggtctggttgtccagacgcgcgacgcgggcgaccgaacgctcgacgtcggccatagccagctccggcaggtcttccggatgctgcttgatgaattcgatcatcgagttggccgagctcttgccgaataccagcaagtccagcagcgagttggtgcccaggcggttggcgccgtgcaccgacgcgcacgcgcattcgccggcggcgtagaagccatgcaccgcctcgccgtggatcaccacttcgccgtggtaattggtggggatgccgcccatctggtagtggcaggtcggcaccaccggaatcggggccttgatcgggtccacgccggcgaacttgatcgagatctcgcggatgcccggcagcttggacatgatcacctcggggtcgaggtgggtgatgtccagcagcacgtgatccttgttcggaccgcagccgcggccttcgttgatctcggtcaccatcgcgcgcgacaccacgtcgcgggaagccaggtccttggcgttcggcgcgtagcgctccatgaagcgctcgccctgcgcgttgcgcagaatgccgccttcgccgcgcacgccttcggtgatcagcacgcccgcgccggccacgccggtcgggtggaactgccagaattccatgtcttccagcgggatgccggcgcgcgccgccatgcccacgccgtcgccggtgttgatgaaggcgttggtggaggaagcgaagatgcggccggcgccgccggtggcaaacaaggtggccttggcctggaacaccacgatttccgaggtttccatttccatggcgaccacgccctgcacgcggccttcggcgtcgcggatcaggtcaagcgccatccactcgacgaagaagtgagtgttggcgcgcacattgcgctggtacagcgcgtgcagcatcgcgtggccggtgcggtcggccgcggcgcaagcgcggcgaaccggcttgccttcgccgaagtcggacatgtggccgccgaacggacgctggtagatggtgccatccggattgcggtcgaacggcatgccgtagtgctccagctccaccaccactttcggggcttcgcggcacatgaattcgatcgcgtcctggtcgcccagccagtccgaacccttgacggtgtcgtacatgtgccagtgccagttgtccggctcggagttgccgagcgaagcggacacgccgccctgggcggccacggtatgggagcgggtggggaaaaccttggacagcacggcggtcttcaggccggcttccgacagttgcagcgcagcgcgcatgccggcgccgccggcgcccacgactaccgcatcaaaatgacgaacaggaatacccattacagcccccaaaccactttaacggaatagatgaaacaggaaaccagccagacgatggtgaacatgtgcagcgccaggcggatgcccaccggcttcacatagtccatccacacgtcgcggatgcccacccatacgtgcaggaacagcgccagcagcgtggtctgggtcagcacctgcacccaggtatggctgaagaggtctttccagccttcatagccggacggcagcgccaacaggaacaacgccagggccacggtgtagatcaccatcaccacggcggtgacgcgctgcatcacccaatcgcgcaggccgtagccggcgccgacaacattgcggtttaccatagagcgatgcctcccagaaccagggtcagcgccaggctgacgaccagcacggtcttggcggtggcgcgggcggtctcaagttccagacctttgtgaatatcgagaaacaggaagcggatgccggcgcagaagtgatgcatgtaagcccagatcaggcccagcagcaccagcttcatcagcgggtgggcgaccacggcgcggtaggtttcaaacgattcggccgaactgagcgaaccgtgcagcagatagatcaacagcgggagggagaagaacagcgccacaccactgacccggtgcaggatggagacgaagcccggcacgggcagtctgatcctggccaagtccagatgcttcggtctttgcttctgcataaggctttccttggatgttttttgtgaccaagagggttacatggcgaccgcccaccacgggaggccgcccggccggctctgcccttgtgtcgggcgatgcctgcctttacctggcacattgccgacgattcatttgcaatatgcgccggggattctaacaaatctcggactaccccgtactgcttccgagtcttttaatctgcgtcaaagcggccagccttcagccgtgtttcactgtataagccagctggtgcgtcaggcagtagcgctgccgccattccagcggactgccgtccatgccttcggacaagcgcagcaggcacagcgccggcacatcggccaccatgccggtcacgcccagaagccccgcctcttcccgcggcagcatctcggcgcggaactgctcgctgcgcacgcgcacgcgcacgccgaaacgctgctgcaaggtggcgtagacgccggccgaattgcgcagccagcgcgcttccatgccatcgaatctttccgccggcagcagcacgtcgtccagcgccaccggcgcgccgtgccagcgccacagctggcgaattctcaataaaggcgccaggcgccgcaattgcaacgcgtcggcgatgtcctcgctggcgttcagccgcgacaggcccaaaaactcccgcgccagatcgtccggctgctcgccgaacagcccaggcgtcagcagcgccgcgtcgccccagtcgcccggcaccggggccacataggtgccgcgcccctgctgccggtaaagcaggccggcggcctccagttcggacaaggccttgcgcaccgtgccttggctcgcgcccagctcgccagccagctcccattcgctgggcagcgcctcatgcgcctgccactcgccctcgcccattctttccagcagccgctgtttgacctgggcataaagcggctgtcttttcagggtattggccgtcatggtctgtgttttaacaccaaacaaatcaagcgtaaaggcaagtcttatataagacacaagacttaaacgagcgtttgatgccatattcttgactgattagtccaaatcgataaacagccgtgatacactcaggccacacctatactgcagggcaacatctgcagctcattatcggataagtcaaaggagagtccgccaatgaaagcccccgttcgcgttgccgtaaccggcgctgccggccagatcggctatagcctgctgttccgtatcgccagtggcgaaatgctgggcaaggaccagccggtcattctgcatctgctggatctgccgcaagcccaaaccgcgctgaagggcgtgatgatggagctggaagactgtgccttcccgctgttggccggcatggtggccaccgacgacccgaacgtggccttcaaggatgtcaaggttgccctgttggtcggcgcccgcccgcgcagcaagggcatggagcgcaaggacctgctggaagccaacggcgccatcttcaccgtgcagggcaaggcgctgaacgaccacgccgcccgcgacgtcaaggtgctggtagtcggcaacccggccaacaccaacgcctggatcgcgatgaagtcggctccggatctggacccgaaaaacttcaccgccatgttgcgtcttgaccacaatcgcgcgctgtcgcagatcgccgccaaaaccggcaagccggtggcttcgatcgagaagctggcggtatggggcaaccactcgccgaccatgtacgccgactaccgcttcgccaccatcgacggccaatcggttaaaaccctgatcaacgacgacgtgtggaaccgcgacgtgttcctgcccaccgtgggcaagcgcggcgccgccatcatcgaagcgcgcggcctgtcctccgccgcctccgccgccaacgccgccatcgaccacatccacgactgggtgctgggcagcaatggcaaatgggtgaccatgggcgtgccgtccgacggctcctacggcatcccggaaggcgtgatgtacggcgtgccggtagtatgcgaaaatggcgaatacaaacgagttgaaggcttggaaatcgacgcgttcagccgcgagcggatggacctgaccctggccgaactggaagaagagcgcgcagccatcgctcacctgtttggctgatacccgagccggatcgaagaaagcgcaccgcaaggtgcgctttttgtctttggtcaaaccgccattccgcatttgcatttattgattaccatcgactgccatttggagtagagcatgattgaagttgaagtcctgaaccaaatcgcggccaagatcgaagacctggccgcccgcgccgccgatattcgggggtatctttgactacgacggcaaaaaagaccgtctggaagaagtaagccgcctcaccgaagatccggatatctggaacgatccgaaaaaagcccaggacctgggccgcgagcgcaaacagctggaagacgtggtgctggtgctggacagcatcaacgccaccctcgctgacagccgcgaactgttcgacatgggcaagagcgaagacgacgacgacaccatcctcgccgtgcaagccgacctggaaggcgtggaagagaaagtggcgaagatggaattccgccgcatgttccacgacccgatggaccccaacaactgcttcctggacatccaggccggcgccggcggcaccgaagcccaggactgggccggcatgctgctgcgcatgtacacccgctacgccgaacgcaagggcttcaaggtggacgtgctggaagtgtccgaaggcgaagtggccggcgtcaccagcgccacgctgaagatcgaaggcgaatacgcctacggcctgttgcgcaccgaagtgggcgtgcaccgcctggtgcgcgtgtcgccgttcgactccaacgcccgccgccacacctcgttctcgtcggtattcgtctacccggaagtggacgacagcttcgagatcgacatcaacccggccgacctgcgcgtggacacctaccgcgcctccggcgccggcggccagcacatcaacaaaaccgactcggcggtgcggatcacccacatccccaccaacaccgtggtgcagtgccagaacgaccgttcgcagcaccgcaaccgcgacgaggcgatgcagatgctgcgcgccaagctgtacgagctggaactgaaaaagcgcaacgaagccaagcaggcgctggaagacaccaagaccgacgtgggctggggccaccagatccgctcctacgtgttcgaccagtcccgcatcaaggatttgcgcaccagccacgaggtgggcaacatcaagggcgtcatggacggcgacctggacggcttcatcgaagccagcctgaagcacggcgtctaagccaaaccggccggctccccgcgggagccggccaagccgtttttattgttttgccgcaggaacccaacccggcacggagtcatcatgtctgatcacgaacaagcaccggcgcaaagccaagacgaaaaccagatcatggcggaacgccgcctgaaactgcaggcgatccgcgaaaaaggcatcgcctaccccaacgacttcaaacgcagccacttcgccaaaccgctgcaggacgaccacgccgccaaagaagcggaagcgctggaagccgaaaaaatcgaagtcgccgtcgccggccgcatgatgctgaaacgtgtgatgggcaaagccagcttcgccaccctgcaggacgtgagcggccgcatccaggccttcatctcccgcgacaacgtgggcgaagacgtctacgccgacttcaagcgctgggacctgggcgacatcatcgccgtcaagggcgtgctgttcaagaccaagaccggcgaactgacggtgcaggccagtgaagtgcgcatgctgtccaagaacatccgtccgctgccggaaaaattccacggcatcagcgaccaggaaaccaaataccgccagcgctacgccgacctgatcatgagcgaggaaagccgcgacaccttcatcaagcgctccaagatcgtgcagaaggtgcgcgacgtgatggtgggcgaaggctacctggaagtggaaaccccgatgatgcacccgattccgggcggcgcgtcggccaagccgtttgtcacccaccacaacgccctggacatgccgctctacctgcgcatcgccccggagctgtacctgaagcgcctggtggtgggcggcctggaacgcgtgttcgaaatcaaccgcaacttccgcaacgaggggatgagcacgcgccacaaccccgagttcaccatgatcgagttctacgaagcgtacagcgactaccagcgcatgatggagatgaccgaaaccatcatccgcgaatgcgcgctggtttcctgcggcgccaccaccgtgagctaccaaggcaaggaagtggacctgggcaagccgttcgaccgcttcaccatcgtggaagcgatcaagcactacaacccgcaatacaccgacgcgcaactgtccgactccgcctgggtggccagcgagatcaagcgcctgggcggcaagctgcccccggcgccgggcctgggcagcctgcagctggcgctgttcgaagaatgcgccgagtcgctgctgtggaacccgaccttcatcatcgactacccggtggaagtctccccgctggcgcgcggctccgacacccagccgggcctgaccgagcgcttcgagctgttcatcgtgggccgcgagcacgccaacggctactcggagttgaacgatccggaagaccaagccgcgcgcttccaggcgcaagtcgcccagaaggatgccggcgatgatgaggcgatgcactacgacgccgactacatccgcgcgatggaatacggcctgccgccgaccggcggttgcggcatcggcatcgaccgcctggtgatgctgctgaccgatgcgccgtctatccgggatgtgatcttgttcccgcacatgcgtccggagtaagctttagcgagttgacattgggctaaagagaaagccgctcactgcaaggtgggcggctttatttatatttaaaaaaataccttgggttttatttccacccaacaaagtgacaggagaaaaaaattaaaaaaacaaatacaacccaagtcaagatgtaaaaataagtacttgcaaacttccaagccaaagtagcacaaaatgactcaaagcatgtcattgcaggaacattatccgactttctaaattcatctgaaaatctatgcttactaataaagtaggtatcatcgactggctcatgattatatgagcaagaggtacgaatcttagcgtattctaaagctagcttctcatactgttccactgtgagagaaggagcttttttttcacactcgacaatgattgaaatacgcgtttgaaaatcattaagctcttctgcatttcgataaagagcatcagccttaactccactcccccccgcccactcaaccagtgtcaataccaaaatcaacaaaccaagacaagcagaaatagcagtcagataattatccaaagaagaacctgatatgacaaaaatcttctgtataaatgcaaccgctataatagaagctgagaataaagataagcttaacgttgaaaatatatcttttcgccgtattcgcctcgcagaattatacctagcactagcagtacgccaagcctttttccgaagctcttccaaactgtctttcatgcgcctcctgcctatttagggcagacctctccaatacaatctattatatcctctcccacaaaatttatagtggaaggttccgattttacggacctagaatcaggtaatgttcacttccgcccccaatgcaactaaagtccatcgagaggtatgcgcatgcattgagaggtctgcttagctattctactacaatctcatcaatacacaaccccttcatccgcatgcattgatgacaatacaaacctcttatagctttgaaatcggctttctatttgctcatcactcaaagactcatctggtgcgactctacccctcgctactaaaaattctaacttatcaaccaaactaacaattgaatcataatttttaacatagccacctgtcgggttaaacttcatctcccagtatgctctagacaattttttcaaattgggtggggccgtaaaatcaaactcaccaagccggccaaacaaattactaatcgcattgtcaattctatacagcaaactcatatcatttatctgattaaaatatgcaatccaaccatatcttttattatctgatatagcaccagccaccttctcatttagctcagaaacaaatatatcttttaacctgcttgaatttaaataacttaatctttccagtcttttacttttattatgtctaaaatcactaaactttgctgcaatggactgcaaaaacctttcaactgtggcatgcctaaccgtgagagtatcaccatcaaaacgatatccaaggtataaaaatggctcgcatcgccttccaaagtgtgtcttttctgaacttaagggatgtagtttcaaccccctagtctgaagcctccttttcaaggatttaaatgcaaattccacactatctctctcaccatacattaacacatcatctacataccgatgatacccaacacccatccccaccataccatcatctattggctgcatatagatagatgacaatatatttgatatagcaagaccctgaggtattccacacgccctcttatatttatgatataaatttttagagcaatttttcggaaccgtcggagtaaccaaagagctcttaatcagtttcaatgcaattttcgatttaatacggcgagaaagcagtgcaatcaacctacttatatctacatcatcataaaatgtaacaatatctgccccacaaacccacgtggaatccataggtagctcagctaactttccagaaatatcccgaatatatacgcttgcgatgttcctagtaactctttcaggatagattatcgacagaaacttatttagctgggaaagaattattctatcgcgtattgttggaacggaaattaatctgggtggcttttctctattttttaccttaagaacctctaagtaaggagaaaatctatacgtcccatttatacttttctcacaagccaaatatatttccgcagcagccctcgatgaaaattgaaagccattaatcctatcaataccttttgcggaactatttttatatttcgcctgataaatatcaatcaaaaaatgagccgaaaaaaggctgcgaaacaagccatcatcatcaatcaccccatcattatactttttaactatgccctctatcataacaaaaaagcctctataaaataaataccgcaacctttacgcaaaagctatcaattaaactataccgctctaactataacattaaccacataatatatatttgtttggtgtccgctccgcggactgatcctttaatgccggttccgcccggcttgacgggtccatttcttttgcttcgccaaaagaaatggacgaaagaaaaggcgacccaacagcgctgcgaaaccccgcctccaaagccctttccaaggcgccgccgaactcgcggggcgctaacgtcgccccgctcaaacaaacggcggcttaaaaccttggaaagggcttcggagtcggcttgcgctgatgggataggggcaagttggttcgactctacaaccagcaaaaagcaaagacattgagatgatacaacatcagcataactcattcatcatgtcagcaagtttgaagctctccatgacatggaggaagacaagcctgtaggaatcttggtcagcagttctgagatatccacacggtagtgtggactggcagacgagaaacaagcacgtttgcgacgtgccccatccccttcaagcctgccgtcgggtggcaggcccgaggttttaagcggctgcctgtttgagtcccgcgacgttagcgcaggacgagttcagccgcgcctcgggtctgacgggaaccggcgggaagccgcaggccaggcttgcagggtggccgggataccgagtgaggccatagagcaggcaaatatcccctccctgccgccgggcagccccggcaacccaaatcatcatccgcgcagcggattcccaaaagcacatcacaggcaaaccgcccgctacttgctcgccttatccagcaagccgccaaacatctccgggtcaaccaagtctctcagcgccacgcccaaggcgtcggccaatgctcccatattgtcgatggagacattgcgctcgccgcgctcgatctctgacacataggttctgctcatccccgcctgcaaagccaacgcctcctgcgacacatcgtgcagacgtctggcaatccgcaggttgcgggcgaaaaccgcgcgggcggttaagggttttgttgtgttttccataccccgatagcatcagcgcttgctagcgctcaagccacacggtatgatttgcaaaatgttaactataagtgactttttgattgttattgatatcttcatgacactcattatgtgctatgcgctgctttgccagccacacatgggggtgcttatgcagaaaattcccattccgtgatctacggcgctttgccgctcccgctctgtcttgaccacatgcagaacgttgcccacccgaccacgacaacgttcaatcaaaatgagggttttgccatgcctagcatcacccgcagttcatcgcatctcgcgctttccctgaaaaaccgccaccccgcccgcagccgttggctgctgcacaacccagtccccacccatccgcccagcctgctggccatgacccggctgcacgaagcctttgccgccttgcaagagcaactggccggcaaggatcaagccaaggtcagagaaccggccgcgcgcgtggcgcatttgtgccacgacatcgagcaggcggtggtggagtccatctgccacctcgcccatggccaattgggtttgcaatccgtgatcgagctgctggcttgcctgggcgacgatgtccgcctgccttccagccgcatcacggagttgctgtcgccgctggacaagcgcatggacgagtcgctgtcgctgctcacccgcgtgctgtaagccctgctccatgagccaacagcctgcccgcttcccagcgacaggctgtttttgattcgacggattttgtagggtggaatcccggcaaagccgggagttccaccgcaatgcgattcactgcgatatggcggtgcaatgcccggctgaacaatggctgcatccaatcgtttcaagccgggtattgcaccctacgcttgcgacgcccgccagccctccagccgtatcaccgagttgctgatgccgctgggcaagcgcatgcacgagtcgctgacactgctcacccgcgtgctgtaagccctacatatctcgcacaaacattaaaacgtatacgatgcgccctattccccttcagcacgcgccgggcaaaaagcgttgggcggggttttaagacgccggcggttcgacgccgcgcgacattcgcgcgcggctagttccggcggctcctcgcccggcgctttttggccggggtttcgcgggctgctggggcggcctggggtcgaaagggggctggccgcgcagccccctttcccgtttgccgggcggaaccggcacttaaacatcgtccgcgcagcggactccatgccgcgcgcaagctatggcgggccgtggcgggagcatcattccgatgcgccggtggtgaagccggtacgccaatcccgccatgcgcctgccgccctgccccgcaagcggcaggtcaaagcgcttcacacgtcaattccaaatcgatatagtctgccgggttgccgcgccgcgcgcggctgcgcttcttggcgccacatggagatgcagatgagcgagaaatacaccgggcagtgcctgtgcggcgcaatccagtatgccgccgccgccgaaccgctgttcaccggcaactgccactgcctagattgccagcgcagctccggcagcgcctatattccggccatggtttttcccgaagcggcggtggaaattgtcggccaggccaaatacttcgcaaccaccgccgatagcggcaatacccacagccggggcttctgtccgaactgcggctcgcaattgttcgccagattcagcgccatgcccggcctgctgggcatcaaggccggcacgctgcacgacacctcgcgctacgcgcccaagctggattttcacgtggccagcgccgcggcctgggactacatgaatccgcagttgccgaagaagccggggccggcgcaaggctaacaagcccatagcccgtccacatccggtctgtcagccccaatcagcagccagtccgcccgctggctgttttcattcgcagcctttccaacgccgtggcatcgcctggccatgagcacgcttttcctgccggcctcaccgtcagcggcaggctctccactcgtcgattaatgccaatgacatctatcggctttataaatagccggctgacgcgccatgcaccaggcgcgcgcgattgcccacccccaggagacgttcaatgaacatgccattcgcggcctggatgcgccgccttgccccggccgccttgctgctgctagccgcccacgccagcgccgccaccgaaaccatcgtgatgatccgccacggcgaaaaaccggaccagggcctcggccagctgacctgccagggcctgaaccgcgcgctggcgttgccgcgggtgctgaccagcgccttcggcgcgccggacgccatcttcgcgcccgatcccgccacccaggtgtccgattccggcgccaactactactatgtgcggccgctggcgacgatagagcccaccgccatcagcctgggcctgccggtcaacaccgcttacggcttcacccagaccgccgacctggcctcgcggctgctggcctccgactatgccggctccaccgtgttcgtggcttgggagcacaagaagatcgtcacgctggccaagcagatcttcgccaacctcaaccaatccgccaatattccggcttggtcgggatcggacttcgacagcatctacgtcatcaccatcaatagctccggcagccgccgcaccgcctcgttttccatccaggcccagggcctgaacggccagagcacggcctgccccggccccaactagccgcagacggcgggatggcctgcgccatcccgccgtgttttctagccgccattccgccccgcagtcgccgtgatccaatcggaaataatcaaccgcgcgatatttccacgcattgcgaatcaaattaagacgccttcttattggtaatgtcgaatcattcgtatttacgcttaattttatcgattcatgccaagcctctccctccgacatatggcaaaccatcataagctattgaaaataatccgtatttacacttagtttttattcaaaaaagggggaaatataaaaaaacaacactaatactcaaatctcagccagcctactgacggaactcatcgccatgactgtgtccaagaaaatccttctgctgattctgctctccatcctggcccagatcggcatcagcgcttacagcctccatacccagtcccagctggccgacaccgccaccagcttcgcaaacgtcgactatcccagcctgattaacttagggcagttcagcaatgcggtgggaacgctgcgcttggccggcctgcacgaattgacctccaccaccgccgccgaccgcgccgcggccagaagcaaagtcggcgacgcctaccagagcgccaaggcggccttgggcgaataccagaaaatgatcaacgacgatgaagaccgcgggcacttcaacgacgatggccgcctgctggaccaatactacgcggcaatgcagcctatgctggcagcggcggagcgcaacaatctggaagacgcgctcaagattcgcgccgatgcggtgacgccggccggcaatgcgctgaccaaggcgatcagcgcccacatcgactacaacaagcgctatgtcgaaaaggaagtggccgaggcccaggccttgatcggcagcacccgcgtcatcacgctggccaccaccgcggtgctcaccctgctgctgggggcgctgggcctgcgcacctacctatccatcacccgtccgctgcatgagctgaaccacgcgatgaaccagatcggcgagcgcctggacttcacccgccaggtcaaggtgcataacgccaaggacgaaatcggcaataccgccgccgccttcaaccagctggtgcagcgcatccgccacagcctgcgcgacatcctgcacaactgcggcaaagtggcgggctacagcgccgacctcggccaggccgccaaccacgtgcagaccgcggcggaaaaccagaaccaggcctccgctttcatcgccgccaccatggagcagctgaccgtcagcatcaaccacgtcggcgatcgcgccgagcaaagcaaccagcaaagcgaagaggccagccgccacgccggcaacggccaccaggtgatcgccaagaccgtggaggaaatccgttccatctccgataccgtcggccacgccaataccagcctcaccgaactggaggcgcaaaacagccgcatcgccaactcggtgggcagcatcaaggacatcgccgatcagaccaatctgctggcgctgaatgccgcgatagaagcggcgcgcgccggcgaaaccgggcgcggcttcgccgtggtggcggatgaagtgagaaaactggccgagcgcaccgccatcctcaccagcgagatcgaccaagtgatacgcggcgtcaccgacacctcgcggcaaaccaccagccggatgagcgaaacccagcaactggtcgcttccggcgtggtgtgcgccgacgaggcgatgacagccatcggcgaaataggcaaatcatccggcaccgccatgcagatggtcagcgaaatcaccgacgccatccgcgaacaggccaatgcctgcaacagcatcgccaaccaggtggaaaagatcgcccagatggccacccagtccagcgcggccgcgcagcaaaccgccaccaccgcccaacagctggacaaggcggtgctggcgatgaacgaggcggtcaaacgctacacgctgtgaggccaggcggccggcgtcaagggctggcgaagcgcgccgagtattgccaggtgaagcagccgctgctgtctgaaaacaactccttggtctggtcgtcggccgcccgcagccgggtgcgcagttgttccagcggcagcgatgccagcgccggagcgttgagcggacgaatcagcgagcgcaccacggtttcgccgctcagctcctccagtcggcagcgtatgccggaaatcgcgtcattgcgctcctcggccagcgcgcccacctggctgcggaagtcggcctgctcgtcctgcagcgctttcagcatcgcgttcagctggttgagctgcttgagcttgggggcggcctgttccgacaaccgcttccagcctgcctgctgctcggccgacagttgcagttcgccctttttcagccgcgccgccaggcccacgtaacgcttgacggtttcatcccccatcagcgccgccaccgcctgctgcgccgtcgccgttttctgcgccccctcctgctgccgcttttccagccagtcctgccgggcggcgaaagccgacaagtccggcagcaagatggaaatcgccgtctcctggctggcgcgcgcgccgacgcgggctatgcgcaccgacttcgcggcgatggcgcaacccatcgcgctgtcgatatcgacttcatcggcgacgatcacgcagcggctggcctcggcgatgcgcacctgccggccgatcaccagcgcgttttccgcgcgctggatggtgatgtcgccgcgctcggcgcgcacctgggcgttggacaccatgccctcgacgctgatcggcccgtcgtcgttcagcgcggcgccgcccaccaggttttgcttcaacaggatgcggccgccggtggagcggaccgtgccgtacacgtcgttgcacagggtcaggttcttgccggtgacgatccggcgctcctgcacttcgccgtgctcttcgtattcgtcgccctgcaaggccaggtcgccggtggtgcggacactaacgccttcgcggttgacgatcttgtcgacgatggcgatctggttggtttcggcgtcgatgctgagaaagccgtcgcgcaccgcgacgatgaactcctggccctccatctcccgcacctcggtgccttcgccggccagggtggccaggtcgaaatcgcgcggcgcggcgatggggatcacgcagccgtccaggccgcgccccggccggctgggcacactaggtgtcttcatcagcagcgccgtattcgctttgatttgcgggtagcggttctggaactgggtcaggtccacccggccgccggacagtttgcgcgggtggtcgtcgcggcggatcgccgccgtcttctcctgcacgccggcgtccaccccgggcaccggcggctgcggacaggcgatcagaaaacgccccaccttgcgctgggccaggcagtcgtcgatgacggcgcggttcagcccgaagcggatgccctgctgccacagatgggcgaccatctcgtcgaactccagccgggaaggcagggtttgcgactcttcgcgctggccgaccaccatcggctggcccgccgggtcgcggccgtagaccggcgtcgcgacgtttctggtcaggaacacctgctcgaacaggtattcaacgccggcctccacctggatcaccgcgtgatacagcgcgcgccgttcctcggcgaaagacaggatgcattgcgcgatccgctgcccagggccggcgttggccgcatcgaagtcgtacaggtagtaacacagtttcgggtaatcgaggccggacaggaaaaaaccggcggcgaagatctggtctatcgcctggcggaaggcttcggcgccgctcaatagctcggtcgcgacaaaaaagccgtcggcgcgcagttggatgaaatccggcagggtgaacggctggccgggatcgggcgcggagccggacccggaaggcgggtgttgcgggagatctgtcgtgcttgccatgatcgcgcctgcctgaacatgccgctgattgccggccgcagcccccagcttgcgcgcaagcacggcccgcggagaaaggaagccgcgccccctttctacaaaggtagcaaactcatgccggctttgcgcgcccggcgcgcggcgccgtccacctcgccagcctgcggcattccttttgcattaaaatgatcatcaggcgcacagtccgcgcagacgccgccaggctggccaaccccatcaccagggattgaggtatcgcatgaaacaggattttgtcatcagagccgcgcaaacaggcgattacgccggctggcggccattgtgggacggctataacgcgttttacggccgcgccggcgacaccgcgctgccggaggccatcaccgcgcagacctgggcgcgctttttcgacccggccgagccggtggacgcgctgctcgccgagcaagacggccgcatcatcggcctggtccacaccgtcatccaccgcagcaccacccggctggcggacgtctgctatctgcaagacctgttcaccgcgccggaggccaggggccgcggcgcggcgcgcgcgctgatcgaggcggtgtatcggcaggcagccgcgcgcggctgcaaccgcgtctactggcaaacccacgacagcaaccgcgcggcgcgcgcgctgtacgacaaagtgggcgagaacaagggcttcatcatctacggcctggagctgccggcctaagcgccgccggccctcccccgccgctcgctttactgccagcgcccccagcgtaccgccagcgaggccagcgccagcagcgcggccagcgtggtcacagccagccagccccattgcgccagcaacatgctgccgcacaccgctccgcccgccatgccgatgaacacgctgacgaacagcaccgcgttcaggcggctgcgcgcgccggggtcgatgccgtagacgatggtctggtgcgcaatcagcgaagcctgcacgccgaggtcgaaacccacggtgcccaggcccagcagccacagctgggcgacggggtccagcagcggcatcaggcacatggcggcgaaggacagcgcgctcagccccgcgcccagccgggccaccaccgccgggccgcggcggtcggccagatggccggccatcggcgcggccagcgcgccggcggcgccggccaggccgaacgcccccgcggcggcgctgcccagatgaaacggcgccgcgtgcagcatcaccgccaaggtggaccagaaggcgctgaagcccatcgacagcaagccttgcgccagcgccgcctggcgcaggctggcgtggcggcgcagcagcgcccatagcgaagccagcagttggcgataaggcagggccgtggtcggcgcgaacttcggcagccacagccaggcggacacgccgatcagcgccaccccgccggccgccagcatgaacatgctgcgccagccccagtgcccggccaccacgccgctcaccacccgcgacagcaagatccccatcagcaggccggtcatcaccgtgcccaccaccttgccgcgccgctgttcatgcgccagggtagccgccgccggcacgatgtcctgcgccagcgtggccgtcaggccgatggccaagctggccgccaatagccaaggaagcgaaggcgccattgagcaggccagcagcgccagcaccagcagcgccgccttggccaggatgatggcgcgccggtcgtggcggtcgcccagcggggccagcagcaaaatccccaaggcgtagcccagctgcgtcagcgtcggcaccaggccgatctcacggctgccggcgccaatgtcggcggccagaatgcccagcatgggctggctgtaatacaacgaggccaccgacagccccgcgccggcggccagcaggaaagtcagcgccttgccaggctggtcggcgcgcgacggcgcggcggccaaaatctggtcatgcgttttttggatggaagtcatcggggtgggctccgtttcacgaatgcccgcagtgtgcatgccgccgcgctgcgatggtagtgggccgccgcgcagatttgttatacattttacgtatgaaaaaacccatcatcagcgatctgtacccgcagccgggcgtcagcctgccggccagcgccggcgaccggctggaactgatgcagaccttcgtccgcatcgtcgaggccggcaatctgtcggcggcggcccagcaactgggcaccacccagccgaccatcagccgccggctgcaggcgctggaaaaatcgctgggaatgaagctgttgcagcgctccacccacagcatgcggctgaccgacgacggcgaacgctgcttcgcccgcgccaaggagctgctggccggctgggccgccttcgaatccgacctcaggggcgcgcgcgaagagccggagggcatgctgcgggtggtggcgccgcacgccttcggccaggaaaggctggtacggccgctggccgattatctgcagcgctatccgcgcatgaaggtggagtggttgctgcacgacgacagcgcggcgcaggacttcatcgccgccggcatagactgcgcgatccaggtcggcgaggtgaccgattcgtcgctggtggcgatcaagctggcggaagtgccgcgcatcgtggtggcgtcgccggcgctgctggcgggcggacccatcccgcaaaccccggccgagctggccggcctgccgtggctggcgctgcgcacctactaccgccacgaaatccgcctgcgccgcgtcgacggcgaagaagaggcacgcctgccgatagagccgcgcctgagcaccgacagcctgtacgcgctgcgcagcgcggcgctgatggggctgggggtcggcgtgggttcggcctgggtgatgacggaagacctggccgccggccgcctgatccagctgacgccggactggcaggccgcgccgctgccggtcagcctggtgtatccgtacagccgtttttatccggcgcggctgcgcggcttcgtggaggtgatgcgcgccgcgctgcccgacgcgatccgcgattagccgcccgcctcgcagcgcgtccggccgcccagccgcctggccagctcggccggccccttcggcggatcggtcaggaacacccgcgcgcgcagctggtaatcgatgaccgcggtgaggtcgccgcagggcaggaacaccagccgcaatgaggccggatcgtcgtacttgggcaagttcaacaatacccggtgcggggtgggcgcctgcggctgcccgcccggccgcgccgggctctgcgtccactccaccagcgcctgcagcccggggcgccactgccggggcaggccgtagcagcaggtgtcggtgtggatgcgctggaaagtggagccgttgaacgacttgctgtcgcggatatcgtagacgtcggcgttctcttgctcgccggcgtagcggttgaccaccatcatgtaggagccgttgaaatagacatcgcggatccacacctcggggtcggttgaaatcgccgcgccgcccaccccgatctcgccgggggcgatcgccttgtcggctatcacgatatagccgccgccatccgccggccagccggcgcagccggtcagccacagcgtcaaacaccaaaccacccatccgaatcgcatgttcattcctcgcccaagctccctgtcactcgccggcccgcggcggctggcaatcgccggccgcgcccaagcggcggcggatttctgcctcatacgcctggccgccgggcaaattccccatcacgcggcgaatgtctgcggcgtcgatcagcacggcgacgcgcttgcatggcaggaacaccagctccaaatgatacgggctggcgtagcgcggcacctcgacattcagcgccagcagcacgcggttgttgtcatgcatatcgcgccagtgatcgagctcgcgggtggtcgtgccgcccggcccgtacggcgggcgcttgctgccatccgcattgcgttcggggctggggtcctgcgtccatttgacgatggcgcgccgacccggctgccattgctcgggcagccacacgctgcaggtgtcgccgctgctgctgcacacgctgttgccgtcgaagctggcgaacagcacctgggaggatggatcgacattgacgaaggtggcggaaaccagcttgcgcttggccgattccggcgtttggcacgccgccaggccggcgcagaccgtcagccacaatagttttttcgcaaacgctttccaatcaggcaaaaccgccctccccttcatcgccgccagccggctgaaaccagcgcccgatgataatccaaagcgccgctggcggcaccgtcacgccgtcgccggaaacggctgccacatctcgacgatgcggccgtcctggtacacggcgatggcgccgaactgctgcagcaccgcctcgctctggcgcgggcggaaaaacaccgtgtcgtcgaccttcagcgcctgccggccggaacccagcaacacctgttgattcgacgacgcgccatacagcgcgctgccggccagccccggcggcgaaaccggatcggccagccagttgccgccatagagaaagtaggcgcgccgcgcgttgacgtcccaggcgcgcagcagcccgcccagccactcgacgccgtagggcagttggaaacgcggcaacgccttcagcaccggcgcggcgatgaaacaggccggcagcaggtcggccagcagcgcgctgtcgaaatcgccgggcttcaccagcgccgagcccagcgccacctcgttctccaccccggagccgtcgtacagccggtaggtcggcgagccgccggcattgaagcaagggctgccggagccggccatcagccccggccaggccttgatttgctcggcgaagccggcgtacgcctgccgcgcatgggcgtgcgcccgagcgcgcaggccgggcagatcgggcagcttggcgacgtgggcgtcgtagcccatcaacccggcccattgcagccggggctcggaacgcaggatgtccagcatcgcccgcatctcgtcgccgccggcgatgccgccgcggtgcaggccgacgtctatctcgaaattgacgcgcagccgcagccgctgcgcccgcgccagctcgcggtattgcgccagccgttgcggggtgtcgaccagccattgcagctgccgctcgggctgaaaagcgccgggcgggaaaccgcggtagaaggccagcgcggcggcggctggcagcggcttgcccagcaaaatgtcgtggtcgccctccgccatcgccaacagctgcggcaagctgaacaacatgtgccggcgagtgccggccagcgccgccgcctcgcgcaacagcgccggacacggcagcgatttcaccaccagccgcagcgggatgcggccgttcagattgcgcagcacctggccgacgttggcgcgcagccgctcccggtccagcaccagcgtcggcgtggcgatgccggccgcgcgcaacgcggccgacaactggcggaaataaccatcgtgcgggctgccgcgctcgccggggcgcaacgaacctagcaacgccgccgcgccggccgcgccgcctgcggccaatagctggcgccggctccactgcggccgcttcatgtccttatcccgaacacccggcgcaggtgcgggttgagcagccgtccgtccgggtccaactcacgccgcagctgcaagaagtcgttccagcgcgggtagagggcggcgaaatccgccgcctggtgcgcatgcagcttgccccagtgcggccggccctggtatttgcggaagatgggcgcgatgtcgctcaccaggtaatcgcaagcctcgccggccgccgcgtgcacggcgatggagcaggagtcgcgctggtaaaaggggctgagccaggcgtcgtcggcctggacgaagcgaaactccatcggaaagaacacctcgttgcgacgctccagccggctgatcaccgcgcgcgcgcaggcgatgccggcctcgcgcggcacatggcattccgactcgttgaaacgcgtcggcctggcggtggacagcagccgccaggacttgtcccgcgcctgctcgaccagccccgggtctatcagtttgcgcgccacccagcgccgcagctcgggcgcgcggcccagccagtcgcgcagccggcgcaattcgcgcagcatgtcttcatcctgcgaatccggatgcgataccgcgccatcggcgctgatgtcgtgggtgatggcggcggcgtaaccggtgaagggcagatagaagaattcgaaatggcggtgccgccgcgccagttccggcgccgcctccagcatctcgcccaccggtttcagccagagccggcgccgcagcgaatacgccggcaccacccggatgccggcctcgactatcacccccaggcagcccagcgacacccgcgccgcctgcagcagctccggctgccgctccaggctgcatgccagcgcctctccggccggagtcagcagccgcagcgacagcacgtcggcatgcagcgccggcagctgcgcgccggtgccgtgggtggcggtgctgatggcgccggcgaaagtctgcgcgtccacgtccggcagattgcgcagcgccaggccatggccatccagctggcgcgacaactgcgacagccgggtgccggccagcacggtggcggtcagcgcctgctggtcctgcgttttcaggccggacatccggtcgagcgacaccagccggccgccggtgggcaccagcggcgaaaacgaatggccggagccgacgcagcgcagcgggccgccgccgcgcagcagcgccgccagttcggcttcgtcggccggcgtggccagcgcctgcgcccggcactggttgaggccgctccagctgcgccacagataagcgccggcaggcttggccgcggctggcgcgccggggcgagccgccagcccggccagcatggcggcgccgcccagctgcagccagcggcggcgagtgacggcggccggcttcatgaacgcgctcccgccgccgcgccggccatgaagacgatcaggcgccgcagctcctcgtcgctgcagtcgttgcaataccccatcgccggcatcgtcttgaaaccgtcgcgcgcgtgcgcgagcaaaaccggcatgccctgccgcagccgcggcgcccaggccgcggcgaaggcggtcagcggcgcctggctggccgccgcgccatggcagcccaggcaggagcgctcgtacttttcggccagccgggcatcggccgggcgcagcgtttcggctttttgcagatccgccgattgcggcttgccgtcctggcaggcccccaggcaaagcagcgcgccgacggacagcgcgcgccgcgcatcaagcgcgaatggaatgggcatatcgaactcgctccggatggcgggagcgcagcgctcccggacaaaaccagagcatcgcgcatccgcgccggccggcccccagcacaagggacaggtccgcccgcctcccggcccgcccaccccgtattcgccctaggtagatacgccgataacaatccgcaagccgccgcttacactccagttaacatcgcccaccctcgcccttttgcccggctccggcggccagccgggccagcctcctccgtcgccgccaccaccatgcaaaggatcccgcgccatgaccatccatcccgcagacggctacccgcacaccagcaagcattacgcctattccgccggcgaccgggccaggcagtgcttccagttcgtccgcgacatcgacgccgcgatgcgcgccaactattccgccaatatcgaagcgataggccgcaacatctatcccatcctgttcgccgaatccaccttcgacggcggccgctacacgctggtggtgaatcccgacatccgccacgtcaaggaaaacgtctgtccgatctacgaccagtgcaaggcgatctcgcacattccgctgggcatctactccatcctgtccgcctaccagtgcgactccaccctgcagcagtgggcgccggcgctggccgcctaccatgaccagatccagcatgtgcacgaccatctggacgagctggaatggccggatgccggcatcaggcaggccaaccgcgagatcctgcacgcgtcgctgcatttcatccgccacacgctggagcgcggccgctacgatatggaggagttcagccactactcgcgcaagctcaccgcgcagatcgtgctgaaccagaccaccgccgcgcagaaccaggtgcgggtgatgtccgacacgctgcgcgaatggaaggcgatgctgggcgaccggtggcgcgatctctacgtggtggtgtcggcgctgtggacgctgtcgcaggagagcgcgcacgaggagatcatcggcgccttcatggacgaagaccgccgcgaaacccacatgattgtttcggagacgccgcattcggtggacgacgcccaggcgctgctgggccgcatcgtcggcgaccgcatcatggcggagatggtgttctcgccgcacggcaccgagaccgagaaggaaaacatctattcgctgtccaccaagcgcgacctgctgtcgcaagccattgaaaaagccatcgccgaaggcgcgggcggcaccgccgtctgcccccacctgtcgcgctgagccgcatccggccccgcccggggccgggtcgagcgccgccgtgtccgtcccccatccctaaaagccggcgcggccgcgccgccgtacatgctgttacggttatgaacagatacaaacagcaatcagtcgtcgcggtttctttgcggctgcgaaacaaaatgccgccatagtgcaagcatacgcaatgcgcgttccaacaaaaggaagcatgccatgaaacacgtgatgacagccgcggcgctgatcgccgcctccctgaccagcctgcccagccaggccgccgatgtcggcgtttccatcagcgtcggccagcccggcttctacggccagatcgacatcggcggctacccgccgccgcaagtggtctatccgcagccggtgatcatacagccggtgccagtcggcctgccgccgctgtacctgcgggtgccgcccggccacatgaagcactgggaccgccactgccgcgaataccatgcctgcggccgccgagtcttcttcgtccgcgacgactggtacaaccgcgtctacgtgccgcactaccagcagcgccatttcccgcatcatgacggctacgagcaccgcgaccaccacgaagagcatcgcgacgaacatcgcgactacccgcgcgaccgctaagccccgccgcgccgtccagccggaccgccgcccagcccagctggcggccgtccggcttttcatcgtacggacggcgcgcgcttcatagaaattaaccacgccgcattggcatgaacccgccgccagcgcgccaaagccgaagcatcgcgcccaatccgcgccgccatcgccgagttcatgccaaaccgccgctgccgacggcgggagtgcggcgttttgccgcaggccggcgctggaacagatgcgcatactttcgctgcgcatgacatctaaaaagggggaaaaccatgccgactcgccatgctgtccatcgccgcctgctgcccgcgctgctgttgctggcgccttccgcatccgcgctggcctgcgccagttgcggctgcacgctcagttccgactgggaaagccagggcttcgccacccagcccgggctgaaaatggatatccgctacgactacctgaaccaaaaccagctgcgcagcggcagcggcaccatcacgccagcagccgccagccagctgaaccagggcaatcaggaagtggagcagtacacccgcaacaattacctgacgctgggtttcgactatgccttctctccagcctggggcgtcaatgtgcaggtcccgtacatagaccgcagccacagcacgctgggcaccggctccgacggcgccaacgcggccagcggcggcggcgcgtacgactccagcacctccggccttggcgacatcaaggtgataggccgctatcagggcttcgccgccgcgcgcaatttcggcctgctgttcggcctgaagctgcccaccggcagccatagcgaaaccggcgtctccaccgatccggccaatccgggcgccgccgcgccgatagaccgcggcctgcagccgggcaccggcaccaccgacgccatcgtcggcgcctactattacggcgaccttggccgcagctggagctacttcacccaggccaccgtgcaaagcgcgctggacagcgccaaccagtaccggcccggcaccggcgtcaacctgaacctgggcgtgcgctatgccggcttctccggctggatgccgcaattgcagctcaacgcccgctacgtgcgacacgacgccggcgacaacgccgacaccgtcagcaccggcggcacgctggtctacctgagccccggcctgaccgtgccgctcacccggcgggcctcggtctacggcttcgtgcaactgccgctgtaccagcacgtcaacggcgtgcagctggcgccgcgctacaccacgtcgataggcgcgcgctacgcgttctgagtcatccgcgcttaagcgggctggcccagcgccgctcctgccgcagcttgtccgccagttggtcggcggacagcgggcggctcagccagtagccctgcagcacatcgcaattcaggccggccagcaccctggcctgctcggcgttctccacgccttcggccaccacctccaactgcatcgcgtgcgccaaggaaatgatggtttccaccaacgtcatcgactcgggctcgtccagcatgcccatgacgaaggagcggtctatcttcagcgcctgcaccggcagccgcgccagataggccagcgacgaatagccggtgccgaaatcgtccaccgcgatggccacgcccaattcgcgcgcctcgcgcagcttggcgatgccgccgtccacatcctccatgatctggctttcggtgatctccagatctatgccgtggtcggcgccgtacggcgccagcacctccgccagcatcgccacgaaatccgcttgccccagctgccgcggcgaaacgttgacggcgacgcgcggcgacgccagcccggcttcgcgccagccgcgatggtcgcgcgccgcctgctccagcgcccagcgaccggcttccacgatcaggcccagctcctccagcagcggcacgaactgttccggcgacaccaggccgcgctcgggatggcgccagcgcagcagcgcctccacgcccaccaagtgatggctgttggcctcgaccttgggttggtagtgcagctcgaactgcccgcgcgccaacgcggcatgcagcagattgcccagttccagcgccgccgccgcccgttcggtcatctcctgccggtaaaacaggctcttggcgccggcggccttggcccgcttcagcgccgactcgacatgctccatcaaatccgaagcctgcgcgccatcgtccggatacatggcgatgccgaatttggccgatagccgcagctcggcgccgcctatctccatctgcgcgtccaggcattcaagctgcaatttctgcacctggcgggccgcctcctcctccccgcccgcctgcggcaggatcagcgcgaactggtcggcgccgatgcgcgacagctgcgaggcatcctgcacatgccgaagcaagcggtcggcgaaacgctgcagcacctggtcgccaatgacgcggccgaacacgtcgttgatggacttgaaatgctccagatcgagaaacgcgatggcgaagcggcgctccgccgcgtcggtgatgcgttgcgccagccgctccgccagcagcccgcggttggcgaggccggtcaggctgtcgtaataggccaggtagtccaatcgctccgtctggccgatatggctgagcgcgaaggcgatatcgccggacaactcgcgcagcagctgcacctcctggcgatcgaaagcgccgcttgcctcggaaaacagcgccagcaccgcctgcgcccgtccatccgtcacgatcggcaggcaagccaccgcgcgcaggccgcgcgccatcagatcccgagccagcgcccgcaaagaggggtccgcttgcacatcgttgcataccaccatttcctgttcgcgcaccgcccggcaagccggcctgtcggcaaacggcgaatcggcgcgcgcgctcaggcggatcagcgcccgataactgtcgtcctcgccgcaaaaagccgccacctcgccgtcgccgctttgcggatccatcacgcctatccaggccatgcggtaagcgccatcctccaccgcgatccggcacacgccgtcgaacagctcccgccgctgatggcagcgcacgatcagcgtattgacgcggctgagcagccggtacaccctgccaagccgctccacgctctgacgcagcagcgactgctgcaacgcgatcgccagttgctgggcgaatacgtccgccacctcctgctgcgcttcgctgaacgcgcccaatttgtccgatgccagattcatcatgcccagcaactcgccagccgccatcagcggaatgcggatatacgattgcataccctgcagacgcagcctctccagcgtggacgagcgccttggcagcgcgtccagatcatccacccggcaaaccagccccttcttcagcctctccagatcctcgaggccgtagctgatcagcgtcagccgctggccgggatcgtagctggcgccgggctcgcgctccaccgccagcacccgggtagcgcccgcctcccagtcgacgatcatcgcggtggcgccccagaacggcagcaggcgccgcaaatagcgcaggcccagctgcgccacctgttccggcatgccggctgccagaatggcgcgcgccagctcattcatggattccagctgctgcaagtggcgccgcaactcggccaacgtgttctcgcgctcgctgacgtctcgcaggataaccgtgtagctgcgctctcccgccacctccagccgcgaaatcgacgcctccagatcaaacagctcgccgccggctcgcatgccctggatctttccctggccgcccatccgccggctgctcgccatcccccggccgaaagcctccaccttgccgcggtggagttcgctcaacattggcggcaacaggcggtccagcggctgacccagcatcgcgtcgacgctgtagccgaacatccgctcggccgccggattgaacaaagtgatgcgctgaccggcgtctatgctgatcaccccatccatcgccgaacgtatcatgccggcgtagcgcgcctcgctgtcgcgcagctcccgctccgccgcctgctgcagggtcaggtcctgggtcaccttggcatagccttgcaactcgccgtcgtcgccgcggatcgcgtacaggatggcgcgcgcccagaaacggctgccgtcgcgccgcacccgccagccttcgtgcacatcgcggccctgctgcgccgcattggcaagcaattgttgcggcacgcctgccgcctggtcttctgcggtatagaaacaatcgaaagaacggccgacgatttcctcggtcgtataccccttgattccctgcgagccgttactccagttcagcactaggccctccggcgacaacaggaaaaaagcgtagtcggtgatcgagtcgatcagcaaccggaactcgtgctcgatccttagcagcgcctgctgcgcggcatgctgggcgctgacatccagcaccacgccgtggatatgctcgcccccgccgaaacgcacctggcgaaaggacagcagcgcatacagcacgctgccgtcggagcggcggagcgccaccggcgcgccttgcacgcagccttgctcccgcaatgccgacacaatggcctgacggtcggcgacgtcctgccagatgcccagctcgcccgtcgtgcgccccagcacagcctgttcctccagaccaaacatatccagaaaagcctcgttcacctcctccagcaggccgtcggccaatcgcgagatcgccatcgccaccgggctgccctcgaacagcgcgcgaaaacgctcgtcgctctgccgcagcgcttcggcgtcggcgctctgccggcgcagcgccgcctccagcttcgctttcccctgcaggtggatttcgctcaccaggctgagcaacacgccattgagcgccaacaggctgagcgacagcagaaacgacatcgggctgcccgccatatccggcgtcgaggtgaaaaacaggtagccgatgacagaggtgatcagaccggtggacagcaagcccggccccacgccgcccaataaggcgctcaggcttatcggtatcagaaacagcagcatccggtggtgcttgccgaactccggatgcaattgcgcgcgcatgccgatgaccagcagcgaactgacgatggcgaacaaatagtcggaaccgtgccggcgtccggccacctcatcaccgggccgccgcaagcggcgcaagccatggaacagcaggatggcggtggccgccacatacagcgcgtcccagcacagggtcagcctgacttgccactgccgactcgccatgccgctctgcagccaatccggcatggtcatcatcaataaagtcaacagcgcgtacccgagcgccagcgccgccggctgatggcgcgggcgcgcggccagccagcgcggcaagcggccaggcggggccagtttggacaggctttcttccggcaattgccgcaaggcaagatacagcaaggccgccgagacaaaagtgaacagaccgtcccaagccaggccgccgaccacccctcctatggcgcggtcggtgtccaccagcacatccggcacgatgatccagatcgaagcgatcactgcataagccgacgtgaccacccaggtcagcccgttcttgcgcgccgtcatccgccctcccatgcgcattcatccgataggtcttaactgagtatggcaagcatttgcggccaggccagcgcgatttcaccggttccgaacgtgattttcagccatgaaaaagcccgcggggctagccgcgggccggggacggatggctggcggcgtcagctttgcggcagcaggctgtcgcgcgtcagcagcgcggcgaagtcgtcggccggcaacggcttggcgatcaggtagccctggacgaaatcgcagccctcctgctccaggaactgccattgctccatcgtctccacgccttcggccaccacctgcatgttcaggttcttggccatattgatgatggcgcgggcgatggcgctgtcgtcggcgtcctgcgggatgtcgcgcacgaaggagcggtcgatcttcagcttgtcggccttgaagcgcttcaggtaggacaggctggagtagccggtgccgaagtcgtcgatcgacagccggaggcccatgttcttcatattgtctatggtctggatggtggcctgcgcgtcttccatgatgatgctctcggtcacctcgatgtccagcgcgtggcctggcaggccgctggaggccagcgcgtgctgcagctgttcggccagatcgggctggcggaactgcagcgccgacagattgaccgccagcgtcagctccggcaggccggcctggcgccaggccaccagctggcgcgtggcttcgccgatcacccagttgccgatctgcacgatgaagccgcgctcttccgccacctggatgaagcgcaccgggcccagcaggcccagcgacgggtggttccagcggatcagcgcctcggcgccgacgatgcggccgctttgcatctccacttgcggctggtagtgcagcacgaactcgtcgcgctccagcgcgaagcgcagctggctttcaatcgccaggatttcgcgggcgcgggcgttgaggtcggcggtgtagaacttgtagctgttgcggccggacgatttggcgtggtacatcgccgcgtcggcgttgcgcaccagggtttcgtagtcgcggccgtcgtccggatagacgctgatgccgatggacggcgtgatggtgatcacgtggttgtgcagctcgatcgggttggcgaacacctcgcgcacccgctcggccgccagcgccgcctcgcccggatcggacaccagcggcagcagcacgatgaattcgtcgcccccctggcgcgccagcatttcgcccggccccagcacagtgcggatgcggtcggccgccacctgcagcaaggtgtcgccggccgagtggcccagcgattcgttgacggtcttgaagcggtcgagatccagcagcagcagcgccagccgctggttgtcgcgcaccgcgttgtggatggccagctcgacgcggtcctgcatgtgcatgcggttgggcaggctggtcagcacgtcgaagtgggccaggaactggatgcgctcgtcggcggccttgcgttcggtcaggtcgctgaagatcgccacgtaatgggtgatttcctccaggctgttgcgcaccgcgtttatcgccagccattccggatacacttcgccgttcttgcggcggttccacagttcgccctgccaggagccgtcttcggcgatggcctgccacatctggtcgtagaagggctggtcgtggcggccggacgacaggatgctggtcttctgccccagcacctcgtgctgggtgtagccggtgatttcggtgaaggcgcggttgacgctgcggatgcggcggtcggcgtcggtgatcatgatgccttcgacggtattttcgaacaccttggccgccagctgcacccgctcttcggcggcgcgcttttccgagatgtcgcgcaccatccgccacaccgcgttgatgcggccgaaggcgtcgcgcatcgccaccgtcttgacgctgaccggcacctggttgtcgaaccggttcagataggtggcttcgaattcgtcgcaatagccgaagcgcagcaccttgttgtcgaggttgaagcgctccagcgcctcgctctcttcggccaccaggctccagaagttctgctgcttgagctggtccaggctgtagcacatcagattgaggaaggccgggttggcgtctatcacctggccgtccagcgagctgatgacgatgccgtcaagattggaccagaacagctcgcggtatttgttctccgagcggcgcagcgcgtcctccacctcgcggcggcgggcgatgtcggcctccagcgccagcgtcttggcgcgcaattcgtcgaccagccgcttcaattcggagcgggtccactccaggtgggtgccgagccggcccagctcgtcgcggcgcgaccactcgaacggcgtatccagcttcagctcggccaacagccgcgcctgctcggtcaacaaccgcatcgggctgaggaagcgcgagtgcaggatgctcatgatcagcatgatggacagcaccagctgcgccgccagtatcatcaggatgttcttcacctggttgctcagcgcgatggccaggttctcgttgtcgaactccatcgtcacctggccgatggcctcgccgcggtagatcaccggcttctcgacgtaggacacgctgccgatgcggcgctcgctgcgcaccgaggacaggaatacctggttggactgggtgtcggtgacgcggatggaaatcacgcgcgggtcttccatcaccgacgaaatcagcggattgccggcctggcggctgaggttccacagcggctcctgcatgcccagcgcgacgatgtcgagcagacggcgctggtcggtttccagctgggtggtcaggttgtccttctgaatgttgaagctgagataactgatgatggaggccggaatcagcaagccgagtatcacggcgatgagaaacacatccctcagattcaagccagagctggcggtggatttatcgtctgcttgttgagccatgtcgcgctagtctttgttcgccgaaaagtcggtgatcgaatgccctgagttgaattcgtttgtgcaatcagcagtatacaccggccgccgccggcttttggccggaatattcaccagtcatcgctcctcgccattttcaagcacatccgcggccggcgcgcggcggatattaaggaatcggcgccgcgcattgccttgccttgccgctgggcctaaaatccacgacactttttgaccaagcattcaggatatgaaccatgccgcagtcacgttatgaaaagattatctccgcccgctggatcatcaccgtggaaactgacggcgaagtcctggaaaaccacgcagtcgcgatcaaggatggcaggattgccgccattattccagcggcgcaggccgccggcctggatgcggacgaacggctggagctgcccgatcacgtgctgatgcccggcctcgtcaacctgcacggccactcggcgatgacgctgctgcgcggcctggccgacgacaaggcgctgatggactggctgaccaaccatatctggccggccgaaggcaagcacgtccacgacgacttcgtgttcgacggcgcgctgctggcgatgggcgagatgatacgcggcggcaccaccaccatcaacgacatgtacttctacaacgccgcgatggcgcgcgccggcctggcgtccggcatgcgcaccttcgtcggctgttccatcctggaattcccgaccaactacgcggccaacgccgacgactacatcgccaagggcatggccgaacgcagccagttcctgggcgaagacctggtcaccttcaccctggcgccgcacgcgccctacaccgtatcggacgacaccttccgcaaggttgtgacgctggccgagcaagaagacatgctgatccactgccacatccacgaaaccgcggacgaagtgaacaacagcgtcaaggaacacggccagcgcccgctggcccgcctgcagcagctgggcctgctgtcgccgcgcctggtggccgcccacatggtgcacctgaacgacgccgagatcgaactggtggccaagcacggtctctccaccgcccacaacccggcctccaacatgaagctggcctccggcatcgcccccatccccaagatgctgcaggccggcatcgcggtcggcatcggcaccgatggcgccgcctccaacaacaagctggacatgctggcggaaacgcgcctggccgcgctgctggccaaggtgggcacgctggacccgacctcggtgccggccgccgccgccatccgcatggccacgctgaacggcgcgcgcgcgctcggcatcgccgacaagaccggctcggtcaaggaaggcaaggacgccgacctgatcgccatcgacctgtcggcgctggagaccgcgccggccttcgatccgatctcgcacgtggtgtacgccgccggccgcgagcaggtcagccacgtctgggtcaagggccgcgcgctgctggccggccgcaagctgaccaccctggacgaatccaacttgaaaacccgcgccgacgattggcgcaaccgcatcctggcgaagtaaacgcatgagcaatgtagacgaactcgaaatcgacaaattcagccagctggcgcacaagtggtgggacaaggacagcgaattcaagccgctgcacgagatcaacccgctgcggctggacttcatcgaccgccacgcctccctcgccggcaagaaagtgctggacgtcggctgcggcggcggcatcctggccgagagcatggcgcaaaaaggcgcgcaggtgaccggcatcgacctggccaagaaatcgctgaaggtagcgcagctgcacagcctggagtccggcgtgcccatcgactaccgctgcgtggcggtggaggatctggcagcggagatgccgggcgccttcgacgtggtgacctgcatggaaatgctggagcacgtgcccgatccgcaaagcgtggtgcgcgcctgcgcccaattggtgaagccgggcggctgggtgttcttctccacgctgaaccgcaacgccaaggcctatctgctggccgtggtcggcgccgagtacgtgctcaacatgctgccgcgcggcacccatgaatacgcgcgcttcctcaagccgtcggagctgggccggatgacgcgccatgccggcctcagcctgcagacgctgagcggcatgggctacaacccgctcacccgcatctactcgctgaacgacgacaccgctgtcaattacctgatggccacccgcctgccggccgcctgaaacgggaccgactccgccaagcccggccccgcgccgggctttcttcattccgcgtccaagtttggctttttctgccctcaggcaggctttttcgcaaaaagcgtgtcaaacagcataaaaatccagggcaccccgtcaacacaacatcaaaacatgcgttttaaccctctggttgatatcatggccgccccaagccgggcggctcgacgcgcgcccggcggcatggcagtgccgcgggccaggcttggccgcggcatttggatacaaacaggctgaccaacaaaatattgccggacaatcctgcatggccatgccgtacaatacttatgaaaacgaaaaaaacgctttccggagatgattcatgactttcaaggccaacgacctgctgaccgagcagatcgcccaatacctaggcaaacagatcatccagggcgacatgcaaccgggcgagcgcatccaggaattgcggatcgccgccgaactggaggtcagccgcggctcggtgcgcgaggccttgctgatattgcagcgccgccatctggtggacattttcccgcgccgcggcgcggtggtggccagcataggcgcgcgcgacgtgcgcgatttcttcgacctgtggttcctgctgctggaccgggtggcgcaaaacctggccgccggctggcagaacgacgacctggcgcgcttcatcgagctgatggcccagctggaggaagacaaccgccgcgatgacctgcaggccttctacgagcacggcatcgaattcctgtcggcgctgtacaaccatgccgacaaccgctacctgaccgataccctgaacgacatgctgccgctgacccagcgctgcctgtacgcgatactgcgcgccggcaagagccagatggacaacacctaccgtttcctggaaagcctgctgaagacgctgatcgcgcgcgacaccagccggctcaagcaaatggtggccactttcggccaggaatacagccagctggcgcaaaccgcggccgaggcgctggaaggccgccgctaagccaccgcttgccggcgcccgccgcccatgaaaaaagccgccggcttccagttggaaaccggcggctttttgtcgccgcggctcagcgccgcaggtaattgacgaaggcgtaagccaggccgccggcgctgaccgcttcctcgcgcgaggcctgccgccagtcggcggcggaaaattcagggaagtgggcgtcgccgtcgtaggcgtcggcgatttcggtcaggcacaagcggtcggccacggcgatggcctgccggtacagctcggcgccgccgatcaggcacacctcctccaccgcgccggccagcgccagcgcctcctccagcgagtgggcgacttccgcgccgtccgcccgccaatcggcctggcgggtcaccacgatgttgcgccggcccggcagcggcttgccgatggagtcccaggtcttgcggcccatgatcaccggcttgcccagcgtggccgccttgaaatgcctcaggtcttccggcagatgccagggcagctggttgtccacacctatggtgcggttggacgccatcgccgccaccagggtcagccgcggtttgttctgcgccgtcataccgccaccgccgccttgatgtggggatgcgggtcgtagccttgcagctcgaagtcttcgaaacggaaggcgaacagatccgtcaccgccggattgagcttcattgtcggcagcggacgcggttcgcgcgttaattgcaattgcgcctgctccagatggttgctgtacaggtgggcgtcgcccagcgtgtggatgaaatcgccggcctgcagcccgcatacctgcgccaccatcatggtgagcaaggcgtagctggcgatattgaacggcacgccgaggaaaatgtcggccgaacgctggtacagctggcaggacagcttgccgtcggccacgtagaactggaacaggctgtggcacggcggcaacgccatctggtccaccaaagccgggttccatgccgatacgatcaggcggcgcgagtccggattcttcttgatcatgcccaggagctggctgatctggtcgatatggcggccgtccggcgccggccagctacgccactggtagccgtacaccgggccgaggtcgccgttttcgtcggcccactcgtcccagatcgacacgccgttttccttcagatagcggatattggtgtcgccggacaggaaccacagcagttcatggataatggagcgcagatggcacttcttggtggtgaccagcggaaaaccgtcggccaggttgaagcgcatctggtagccgaacaccgagcgcgtgccggtgccggtgcggtcggccttgtcgtggccatgctccatcacatggcgcatcaggtcgagatactgttgcatgttggcgatcccatcgataatcgctgcattgtaccgcctgcgccgccggcaagcgaggctgcggcgctggccggaacagcccggcataggctaccattcagtttaaaatcaagacaaaagcattattaaagcgagcccatggcagaagattccgacctcgaacgcaccgaacccgcgtcagccaaacggctgtccatggcgcgggaagacggcaacatcccccgctcgcgggagttgtcgacgttcgccgtcaccatggccggggtatcgctgctgatgaacctgggcggcaagatcggcaccttcctcggcgacaccatgcgccacctgctgaccttcgaccagagcacggtgcaaagcaccgagccggtgctgctgcgcttcaaggaagccattttcggcgcgctgtggcaattggcgccgttcttcgccggcctggcgctggtggcgctgttcacgccgatgctggtaggcggctggaacctgacgctgaaagcgatcggccccaatttcggcaagctcaaccccttgcccggcatcaagcgcttgttttcgctgaacgccgtcaccgaaggcttcaaagccattctgaaaagcctgctgataggcggcatcgccacctggtacatctggcgcgagcgcggcgaagtcatcggtctattggcgatgccgctggaatcggccatcctgaagatgaccgacctgatcatccacaccttcttcatcgtcgcctcggcgatgatcctgctggtggcgatagacgtgccctaccagctgtggagctactacaagaagctgcgcatgaccaaggaagaggtcaagcaggaatacaaggaagccgaaggctcgccggaagtgaagggccgcatccgccagatgcagcgcgaggcggcgcgcaagcgaatgatgcaggaggtgcccaaggccaacgtgatcgtcaccaacccgacccacttcgcggtggcgctgaaatacgacgacaccatgcgcgcgccgcaggtggtggccaagggttcgctgaagctggcggaaaaaatcgtcgacaccggcaagggcagccatgtgccggtgatgcgctcccccagcttcgcgcgggcgctgtacttcaacgccgagctgggcgaggacattccggcgccgctatacgcggcggcggcgcaagtgctggcctatatcttccagctgcagcaataccaggcggtcggcggcctcgcgccggtgttcccggacaagctggaagtgcccgccgagcttgacccctacagcaaacgtccgcaagattcggcgcctgaagaaagcctataagccagcatggactccatcctacagatcctccgcagcctcaagatctcccagctcgccgggccggtgctcatcatcctgatcctgacgatgatggtgctgccgctgccgccggtgctgctggacatcttcttcaccttcaacatcgcggtgtcggtgatcgtgctgctggtcggcatcaatgtcaggaagccgctggatttctcgtcctttccctcggtgctgctggtcaccacgctgctgcggctgtcgctgaacgtcgcctccagccgggtagtgctgctggaaggccataccggcccggacgccgccggcaaggtgatcgaatcgttctcccacttcctggtgggcggcaacgtcgccatcggcatcgtggtgttcgtcatcatcaccatcatcaacttcgtggtgatcaccaagggcgccggccggatcgccgaagtgtcggcgcgcttcaccctggacgcgatgccgggcaagcagatggcgatcgacgccgacctcaacgccggcctgatcggcgaggacgaggcccgcaagcgccgctccaccatcgccgaggaagccaacttcttcggcgcgatggacggtgcctccaaattcgtccgcggcgacgcgatggccggcatcatgatcatcctgatcaacatcatcggcggcctgatcgtcggcgtggtgcagcacgacctgccggccggccaggcggccgaaacctatacgctgctgaccataggcgacggcctggtggcgcagatcccggcgctgatcatctccaccgccgccggcatcgtggtgtcgcgcgtcggcaccgaacaggacatgtcggagcagttcctgacccagctgttcaccaagccgcaggtgctgtacatcacctcggcggtgataggcatgataggcctgatccccaacatgccccatctgtccttcctgctgatcgccggcgcgctgctgctcctggcccggatgatggagcaacgccggctgcgcgacttggcccgcgaacagcaggccgcccagccgccggcgccgccggagcagcaaggcgcggaagtcagctggaacgacgtccagcacgtcgaccagctcggcatggaagtgggctaccggctgattccgctggtggaccgtacccaggacggcgagctgctgcgccgcatccgcggcatccgcaagaagatcgcgcaggatctgggcttcctggtgccgccggtccacatccgcgacaatctggaaatcaagcccaacgcctaccgcatcctgctcaagggcgtggagctgggcaagggcgaggcctatatcggccagttcctggcgatcaaccccggccgggtcagcaaggagatcgccggcaacgccaccaccgacccagccttcggcctgccggcggtatggatagaggccggcaagcgggaagaagcgcaatctctgggctataccgtggtggatgccagcaccgtggtggccacccatatctccaacctgctgcaaacccactcagccgagctgctgggccgcgaagaagtgcaggcgctgatagaccaccaggccaaggaatcgccgaaactgatagaagacctggtgcccaaggtggtgccggtcggcacgctgcagaaagtgctgcaacagctgttgaacgacggcatccacatccgcgacttccgcaccatcgtggaaacgctggccgaccatatcggcgtcacccaggatgtggacgagttgaccggctccgtccgtaccgcgctgtcgcgggtgatcgtgcagcagctcttcccgggcgaagccgaactgccgctgatgacgctggagcctcagcttgaaaacgtgctgatgcaggcggtgcagtccaaggccggcggcggactggagcccggcctggcggaaaacctgctgtccagcgcggcgcaacagaccgaacaggtggagattcagggttacaatccggtactgctgaccgcacccggcctgcggccgctgctggcgcgtttcctgcgccgggcattgccgcagctgcgtgtgatttcgcataatgagattccggacaataaatccattcgtataattgcggtaatcggcggcagcaagggctaagggctaatcaataatggtggtgaaaaagttcttcgggaagaccactcgagacgcactcaggcaagttcgcgaagaactgggggcggacgccctcattttgtccaatcggcccaccatgggcggcggcgtcgaaatcatggcggtggccgacgccgacgtcgccaacctggccagcacgctgtccacctccagcagcaagcacccgccgcgcaacgcgccgccggcggtgaaccgcccgcagcagcccgcgcccatcccgcccaacggcagcgcggtgaaccgcgccatcgcccgcacctacgcgatgccggtggagccgctggaaagcccggcggcgccgcgtctggaaagcgcccctcggccgcggatggagccggtctacgcgccgcccgagccggcgcaggccccgccgcgccaaagcgcgcaaccggtccgtccagccgccgcgccccagccggcccaagcgcgcccggcggcgcggccgccgcaaatgccggcgtcgccgccgccgacgctgtcccacgccaatggcgaggagccggaacaaatggcgcaggaactcagacagataggcgacgagatcaagctgctcagaagcctgctgcaaagccagctggccagcttcgcctggtccgacatggagggcaaggcgcccaatcgcatcgagctgttcaagcacctgctggcgatgggcttctccgcgcagctgatccgccaactgattgaaaaaatgccggcgcaataccaagccgaagtggcggtgaaatgggcgcgctcggcgttggtgcacaatctgaaatgcgccgacgccgaccgcgaggtgatggaccgcggcggcatcttcgcgctggtcggccccaccggcgtcggcaagaccaccaccgtggccaagctggccgcccgcgcgacgatgcgcttcggcgcccagcacgtggcgctgatcaccacagatagctaccggatcggcgcgcaggaccagttgcgcatctacggcaagatcctgggcgtgccggtattttccatccagaacgagggcgacctgcagctgacgctggccgacctgtccaaccgccacatcgtgttcatcgacaccgtcggcatgggccagcgcgacgcgcgcgtgctggcgcagatcgacatgctgcgcaccgccggccggccgatagagcggctgctgctcttggccgccaacaccgacggccatacgctggaagacgtggtgaaacgctaccgcggcgacggcctggccggctgcatcctgtccaagatagacgaagcggtggcgcaaggtcccagcctggatgtgatcatccgcaaccggctcaagctgtatttcatcaccaacggccagcgcgtgccggaagacctgcactcggccaacgccgccttcctggtggaccgcgcgatgcgcgcgcagcagataggctcgccgttttcgctgcaggccgatgaattgcccatcatgcaggcggctcaggccggatggctgtgaacgcgatgacggatcaagccgccagcctccgcctgctcgccgcgcagcagaaccgcgctcccagcttcgccttcatcggctcggagcgctccggcaccagcaccgtggtgaccgagttggcgctgggcctggcctatgccgggctgcggccgctggtggtagactgttgcctggggcaggtgcagacgcgccgcctgggcgtccccgccaccgccacgctggaaagccaggtggtcaacgccggcgggctggacgacatgatgatcacctcgcgccagggggtacagctggtcaatctctatgcgcggccggaacagcgcgcgctgttctccgcccaactgtggctcaggctgggcagcgaattcggcgcgcaggagcgcgacgcctcggcgctgctgatcgacgtgcccaaccccggcctggacgccatccccgccagcgtggccgacaacctggtgctggtgctgaccccggccgccgaatcgctgaccgccgcctacgccaacatcaagcgcctggccagcctgtacggccgccagcgcttcaatgtgctgatcaaccgcgcgcgccatctggacgaggcgcgcgagctgttcacccgcctgtcggccgtcaccagcgaattcctgacggtgtcgctgcgctgggtgggcttcgtgccgcaggacagcgccgtgcgccgcagccagacgctgcaccgtccgatgatggaagccttccccgacagcgaggccgccgcggcgttttcccagctggcggcggtgctgctgcattgggacgcgccggaaaccacacgtgacaataccggatacatggacttgctgattgccgcctcgcgcgactgggccgaggcagatggagccaaacccctatgaacccgtcctttcgccgatcgggctacgccaatgcggcccccagcgtcgagatagacgtggaggcccacgcgccgctggtacgcaaactggccagcatcatgatcgcccggctgccggcctcggtggatctgggcgacctgatccaggtcggcatgatcggcctgatcgaagccgcgcgccagttcgacccggcgcagggcgtgatgttcgaaactttcgccagtcagcgcatccgcggcgcgatgctggacgaactgcgccgcgaggactggctgccgcgccaggcgcgccgccaggcccgccagatcgaagaagcgatcgcccggctcgaacagcagctcggccgcgcgccgctggagtcggaaatcgccgccgagctgggcgtggagctggagcagtaccaggacatgctgggagaatgcaagggcaccaccctgctacacttcgaggacttcgccagcgacgacgagaacccgcacaacccggtggccaacgtcgccgacgacgattcgccggacccgctggcgacgctggccgacgacagcttccgccagcatctgatcagcgcgatcaaattcctgcccgagcgcgaccagctggtgatggcgctgtactacgagcaggagctgaacctgaaggaaatcggcgcggtgctcggcgtcaccgagtcccgggtctgtcagctgcacagccaggccatcgccaggctgcgggcaaaactgaaagactggctgtaagggaaggcccggtttgcgtgatgccgggcttcagaccagatcaataacggaaacaccttgtggacaagatcagtcttatcgccatcatcctgggcctgaccgccatcgtcgccggccaggccatcgaagggggcagcctcggctcgctgatgcagctgaccgccttcatgatcgtcatcggcggcaccaccagcgcggtgatgctgcaaagcacgcccaagcagttcatggccggcctgcgcatggtgcgctggatcttccgcccgcccaatttcgaccacgagaaaatgatccgcgaagtggtgaactggagccagacctcgcgcaagggcggcctgctggcgctggaaggcgtgatcaatcagcaacgcgatcccttcaccaagaaagcgctgcagatgctggtggacggcaccgagccggacacgctgcgcgcggtgatggacgtggaaatcagcatgttcgagcacgcccgcaagcaggcggcgcggatctgggaatcggccggcggctattcgccgaccatggggattctgggcgcggtgctgggcctgatccacgtgatggaaaacctctccgacccatccaagctgggcggcggcatcgcggtggccttcgtcgccaccgtctacggcgtcggttcggccaacctgtttttcctgccggtcggcaacaagctcaaacacttggtggcgtcggagctggcgatgaaagagctggtggtggagggcatagtcgccatcgccaacggcgaaaacccgcgcatcatcgaaagccggctgcgcggcttcctggcgatgcatgaataaaccgctaccgcgttagctcgcaaaaaaggcaagccaggggggcttgccttttggctttgcgctgtcagctcactgcgccgccagttcccgctccggcttgcgcagctcgctctccagcaacttgtagtagtccagatcgaaagccggctcgccatccagttcgccgccgttgcggcgcgaaccaaggtagcaccagcggtcgaacagatgctcgaccacgtcgccgcacacctcgtcgcgctccaccaccgccaccgccccttcgaacggccactgcctgaccttcaggcgctgcaaggccgacaccaggcgcagattatggctgtccgcgccctccttgccgacgcaggccccgcggcagcgattcaggctgtaggcgttgcaggctacgcccttgcggctggtcacctgctccacccccagcaccgcctggcacagcccctgcgccagcgcgatctgcgccagcgccttgcgcgcctcgcgcgcgtggcggaacaggccgtaaagatcggtggtgcggctgaaatcgatatcctgcgccgacaccgcgcgcagccgcgcgaaaccgtcctcctccacccgcagttgcagcgaacaggcctcgctcaacatccgcgcgcgcgggttatgcagcggctgataggcgcgcagccactgcagctcctgcagatgcgcgccgaattcgcccaggctctcccgccactccacccgcgccaccggctcgtcgatgcgcacctcgtggctcttgtgtccgggcttggccttggcgaaatgccccagcaccttgcggtacagattggcggcgcggccgacatacagcgcctcgcccgccgcgccgaacagcgcatagacgccagccgaatcaggcagctcctcgatctgttgctgcaactgcggcgcaagatcgccaagttcggccggctgcgacaacagttgctccgcctcatgcgccaggcgcccctgtcccagctccccttccgcgatccgcaggaagcggtacaccgcctcggcatcggccagcgcgcggtgccgctccggcatgtctatgccgtgacgcgccaccaggctatccaggctgtgcttgaaatgctgcggatacagccggcgcgacagcttgaccgtgcacagcgcccgcgtctggaagcgcaggccgtggcggcgaaattcgttcttcagcaacccgtagtcgaagcgggcgttatgcgccaacaacaggcggccttgcaaccgcgccagcagctcctcggccagttcggcgaatggccgcgccgcggccaccatctcattgctgatgccggtcatgttttcgatgaacggcggaatcggctggccgggattgaccagccaggcatggcgctccacccgctcgccgtcgatcaggatcacccccacctcggtgatgcggtcgcggctgatattgccgccggtggtttccagatcgacgatggcgcagggttgttcaaacagggtattcaatctatccatcgctttcagtcgtgcggcgccgcgcgccggacatgccattcgccaggccatgttggaaggccgcgacagcaattgcgggccagtttaccggctttgcaaaaaaaagtcccacgaggtgttgacaggccaaatggccctctatattattcacctcctcgcaagacacaacgtctcgcaaggcagtgcacccgtagctcagttggatagagtatctggctacgaaccagagggtcgggcgttcgaatcgctccgggtgcaccaaaaatcagcgtccctatagtttagcggttagaacaccgccctttcacggcggtagccggggttcgattccccgtggggacgccaaagctgcacccgtagctcagttggatagagtatctggctacgaaccagagggtcgggcgttcgaatcgctccgggtgcaccacagtttcagtccctatagtttagcggttagaacaccgccctttcacggcggtagccggggttcgattccccgtggggacgccagaatgaaaagaaagcccgtcatctcagcatgacgggccttcttcattcccgatccgccgttctaggcggcaaagctattcaccagcattcccgccacgcccagcagcagcaccgccgtgatcctctgcatcaggcgctgtcttctcggctgatccagcacatgcttgatccgctgcccgaaataacaataggaacacccgctggcgaactgcagcagcagaaaagtcagccccaggatggcgatgtccgccgcccggctgcccgcccgcccggcaaactgcgggaataccgcgctgaacatcagaatcgtcttgggattcgaaaatccggtcagcatgcccttgatgaacaactggccgaatctcatatcactcgacaaacccgccacttccatccgcacgcccttgctggtccattgccgatacgcgaggtaaagaatatagcccacgccggcgatctggatcgcactcatgacaaacgggtcgtttttcagcagttcggacaagccgatggcgaatatcaaaatggaaaccaggtacgaagccgaagcacccaactgcgcgggaatggagctacgcaatccattcctcaacccaagactcatcaagaaaaccgtcatgggaccaggactgaacgtcgtcgtcgcgcagaaaataaggaaataagaaaattgctgcacttgcctctcaaaatggtaagcttgaaaaaaaccccatgcatggcaatggggaaagggtagtatgttttggctgccaaattctgagtgccggtgaagtaaatccaatcttttcatcttaactcacacatgctgctttagttaaaagtctaactctggtttgtatttctgtaatgattttcactccctcttgcaaatccaccatatgaatcccaggctttccaaacccggaagtcttcgtatcatcaagcggaatcgcatagcgttgaatatagcgttgataatcctttagcagcaaattgcaaactcgcaacattgctcttggattattagtcaggacagcatgccccaacaggtcaaaattatgcaaagcatcagccagctgaaaaatacccttgccattcagcaagcgacagccccggctatctattttctcgctgcgctgccgaatcgtagttgcaacgtgagccgcatagtacaaaagccttgccagctcgcttgttaagttaagctcctgcgtactcattgctcacctcgttttattaatttcaacccgccaaccgattgatctccgcaaatcagattaaccacaaaccccaaattcacacgaagtagaataaattctgagtaagcgttacttttagatcaaaacacagctatcatgcacgcctgaaagaacgaataccattcaaatggtataacgctccacatgatctgattaatttctcccacgtactgcagcggaaaatatttagctaaagatttttaatgacctactcagaattgacccagacaagacgaagcagtccaccagcgatcacatgcgcacagaataggtctcgggattgattcataacagataaagcctggcttcaaatgacaggactttaccggtaaaatccccggcaaagtcaaaaggaccacgatgccaatctccccgatcgcctttcatccaggcagtcccaaggttcagcaaatcgtcgaatccctgagcgaagccatcctgcagggcaccatccctgcgggcagcaagctgccatcgatccgcgagctgacgcgcctatttggagttgggaaattcacggtcatcgacgcgctggataggctgcgcggctgccatctggtgtcatcccggcaaggccggggctttttcgtctccccgctcaatgcggcgccgactgcggcgccgctggccgacttgatgccgcaagacctgatcagcatcctgcgccgctcgctgatagccgacaacggcgccatgcgccccggcagcggccacctgccggaaagctggctggataccgacgcctaccgccaggcgatgcgcgcaaccgtgcgttcgccgctgctgaggatatccggctacggcagcccggccggctatctgccgctgaggcaagcgttgcagcagcggctgagcttgcaaggcatgaccgtccaactggaacagatcgtcactaccgccaataccgtgcaagcgatagacatgctgctgcgcctgctgctgcgccccggcgacaccgtgctgctggacgatccctgctatttcaactttcacgccaatctggcgctgcatggcgccagcgtcgtcaccatcgcccgcaacaccggcggcatcgatttcgatcagctggaaacgctgctggccgcccgaaagccgcgcatctacctgaccacctccctgctgcacaatcccaccgggcactctttcacacccgcccaatcctaccgcctgttgcagctgaccaagcaatacggctgccacatcgtggaagacgacctatacggcgacctgcacagctcgccgccgccgcggctggccgccctggccggctttgatcatgtcagctacctctccggcttttccaaggtgctgagcgccaacacccgagccagctacgtggtgaccacgcccgacctgtcggccaagctgtgccatttgaaattgatgagcggcggcatcacgtcggagctgctggaacaactgctttgccgcatgctgaccgagggcagctacggcaagcaccgcaatcgcctggtggttcgcctgctggagtccggttcccgggtggccgagtggctgcggcagagcggctgcgagccggcccactcctttgacggcggcatgttcatctgggcgcggcttcccgccggcatcgatgcggaagaactggcgcaacgcgggttggaacaagatctggtgctcgcgccgggcacgctgttcagccggaatcccgacgcgcgccgcttcatgcgcttcaatgtcgccagcagcgacgatgccggcgtcgcccacagattcgccatgctgctgagccaagcccgcgccgccagcagggtctgacgttccgccgagcggtcaggaagcgccgcccttcaaccctcccggcaaagatgcaacaccctgtcgccggcatatatgcctaaagcattaatacttctatttttcttgaaagcatgaaaatgacatggtgttagattgtattcttcgaaatttctatgggatcagaccctgtctgatgaatttctgtgagaatccaacacaagataaacacatatgtcattcccgccttgctcggcctcgcggccgttccggcgatggccgctgccggcgatgccgacagcgcggcgctggagcgcgtcaccgttaccggctcgcgcatttcccgctccgcccaggaaggcccgaccagcgtcaccgtgctgaccggcagcgacatcgaaaaacagggctacaccaatgtctacgacgcgctgaacagcctgccgcaaaacaccggctttacccagggcgccgacttcggcaacaccttcacaccggcagccaacgccatcagcctgcgcggcctggggcccaaccacacgctgacgctgatcaacggccgccgggtcgccgattacccgacggcgtacgacggctcggtcaacttcgtcaatctggccaatattccggccgcgatgatagaccggatagaaatcctcaacggcggcgcttccgccatctacggctccgacgccatcgccggcgtggtcaacgtcatcctgaaaaagaagaccgatggcgtggacgtcaacgtcaaggtcggcgccagcgagcaccatggcggcgagaatggcaggctgcaattgagcggcggccacagctgggatcaactcagcttggtctacgggctggagctgagccagcgcaacgccatctggagcaaccagcgcggcttcatggccgacaacagctcggacggctccgccccaaccaccatctggtcgcaacagatcaaacaggggccgaacaaggggaaatacataggcgcaggcgattgcagcgctttttccagcctgttcaacggcagcgtccgcccctacacgatcaatagccggaccggcaacggcgtggtctgcgccagcggccaggccagcccggactactggaccatccagaccgccaaccagagccagaacggctacctgagcgccaattaccagctcaacgagcacgccgagctgttcagcgatgccctgctcggcttcaatcacaccgaaaacaacacccgcggcccggcctggacttcgctgggcggatccagccaatacttcctcaaccaaaacaccggccaatacgagcaatggacccgacggctggcgccggaggaaatcggcggcgccaccgtctacaaccgcaaatgggacgacctgtccgccaacctcaccttcggcgtgcgcggcgacctgcccggcaccagctggaactatgaagccgcgtacaacgcctcgatctacaccagccagcaggccgcgccgaggctgctatccaacgtggacagcttcttccttggcccgcagcttggcaccgacagcaacggcataggcatctacgcgcccaacgcggcccacttcgccgccccgatcacgccggcccaattcaacagcatcgtcggcagaagcttcgagcaggacaagtcctggctgcaggcgctgagcctcagcggcagcggcgacctgttcaagctgcccgcaggcgcggtcaaattggccggggcgctggaatggggcagccagggcttcagcaacgatcccgacatccagctggggcaaggcgtgttctatcgagcctcgcccggcagccatgccggcggcacccgcgcgcgccaagccgccggcgcggagttgttcattccgctgcataagcgcctgaacgtcaccctatcgggccgctacgaccgcctggccatcgccgacagcagcgtcggcaagttcacttatggcagcggcctggaattccgcccgctggacacgctgctgctgcgcggcaactacgccaccagcttccgcgcgccggacatgaactacctgtttctgacgcaaagccgcggctactatcccagcgtgaccgactactggcgctgccagcaggcgggccagcccaccgccacttgcgactacaaggacctgacagccaatttcgtcaaaagcggcaatccggacctgaagccggaaaacggcaaatcctacggcttcggcttcgtttggtcgcccagcgccgacgccgacctgtcgctggactactggaacatcagcatcaacgacctggtgaccgacctggatcaggacaagattctgcgcgacgaggcggcttgccgcagcggccagctggacagcaactccagcctgtgccaggacgcgctgcgacgggtgcagcgcaacccggccaacgccgtgctggacccgggcgccatcaaccagatcctgaccaatccgatcaacgccgccaacgaacgcaccagcggcatagacctgaacggcaagctgcgctggcggaccgcgaaatggggccgcttccagctgcaggccagctactcccaggtgctgaccttcacctatcagcaattcgccggcgaccccacccaggacaggctgcaagacctgagcaacagcgactggcgcaacaagctgagcgccagcctgggctggagcatcggcaactggtcgtccaccctgcaactgacgcgctacggcaaggtgcccaacaacgcccaaaccggctacctgacgcccaccatcctggccaatctgagcctaggctatcagctaagcaagcagacttcgctaggcctgatcgtcaacaacctgcaggacttcatcaagaaagactacagcgacggctcgccgttctatccggtcggcacctacctaccctacggccgccaggcctggctggagctgaatcaccacttctgaaatcgcaccgcgcggaaaatgaaaaaacgggatgcattgcatcccgttttgcatgaatcggcattcaagccgcttcccgtggaaaaggcggcctgaatgcgatggaagaaaatagaaaaagcccagcattttcatgctgggctttttctgaatcctggcgtccccacggggaatcgaaccccggctaccgccgtgaaagggcggtgttctaaccgctaaactatagggacgtcttggtgcacccggagcgattcgaacgcccgaccctctggttcgtagccagatactctatccaactgagctacgggtgcagtttctggcggagaaagagggattcgaaccctcgatacaggtttaagcccgtatgcttccttagcagggaagtgccttcgaccactcggccatttctccgttcagagagcgccatattaaataggggcgctcttgctgtcaagcataaatgcaaaattatttatgccgcctggtccaggccgaaaaccttatgcaaaacgcgaaccgccagctccagatatttctcgtccaccagcaccgaaaccttgatttccgaagtggagatcatctggatgttgatgccttcttcggccagcgtgcggaacatggtggaagcgatgccgcagtgcgaacgcatgccgacgccgacgatggaaatcttggccaccttgtcatcggcatcgatcttggccgcgccgatatgggtctgcacctcgcgcaggatggcaagcgtgcgctggaactcgccgcgcggcacggtgaaggagaaatcggtggtgccgttttcgccgacattctggatgatcatgtccacttcgatgttggcatccgcgatcgggcccaggatctggtaagcgatgcccggcttgtccggcacgcccttgacattgatgcgggcctcgttgcgatcgaatgcgatgcctgccactaccgccttttccatgctctcatcttcctcaaacgtaatcagggtgccctcgccttcgtcttcgaagctggagagcacgcgcaagcgtaccttgtacttgccggcgaactccaccgagcggatctgcaataccttggagcccagcgacgccatttcgatcatctcttcgaaagtgaccgtcttcaggcggcgggcctccggcaccacgcgcggatcggtggtgtagacgccgtcgacgtcggtgtagatctggcactcgtcggccttcagcgcggcggccagcgccaccgccgaagtatcggagccgccgcggcccagcgtggtgatgttgccttcctcatccacgccctggaagccggcgacgatgaccacgcggccttccttcaggtcggaacgcatcacctcctcgtctatcgactggatgcgggccttggtgtgcgactgatcggtcaccaccttcacctgccagccgcaatagctcttggccggcacgccgatttccttcagcgccatcgccaacaggccgatggtgacctgttcgccggtggaaacgatcacgtccagctcgcgcgggtccgggtaatcctgaatatccttggccagggcgatcaggcggttggtctcgccgctcatcgcggaaaccaccaccaccacatcatgcccctgggccttccatttggcgacgcgacgggccacattcttgatgcgctcggttgtcccgaccgaggtgccgccgtacttctgtacgatgagtgccatacgtgcttcttgtttcaaaatggttgaaatgtcgagcttcgattctgaccacagaatgtcgataaatgcaaggctgaattggcaaagtcgaacatgccggcccacgccgcgcctcgcatcccctggcgcacgccatcgcgctaagacaactggctggctgtttgcatcccctaagcctaaaggctacaaaacagagagagatcacgatccgactgacgggacccatgcatgactgcccctgttcaaccctggcgctggatccggctggaaatcggcctggtcgtcaacgggggaatccagtacgcgctgttcatcgaccatcccttgttctggccggctctcggccttaccaccctgctgttgctgctgttgctgctgtggccgcgcagcctgcccgccgcctcccgcccgccgccgcgcgacatcggctcgcaggcgcaatactggcgcgatgtcgccggccatgtttacgcgctattgccgctgtgggccggccacatcgccttggggcgcgaacagatagacgaggccgccggccggctgaccgggcactgcgacaatatgctgcgccagcttggataccaggcgccggagccggcggatgccgccgccgagcagaaaacggccgacgcccccccgctgggcgcgccaagcggcctatcgccgccggacaggatgctgatgcccatgctcaagcaactgcagcaatcggccctgcaactggaagcgctggctcaggcgcgggaaaacagccagccggatgggcagatcgccagccaggtcggcaatctgctgcggcagctggaaacgctggagcgcgactcccagcctccgcccggccagaagcgcgacggcaacgcggccggcttcgatctgcgggccgccgccgaggacacgctgacccagttgcagttccaggaccgggtcaaccagatcctgtcccacgtccagaacgatatctggcagctggaagccatgttgcacgaggcgttgagcagcgaggacgagctgccggccccgccggataccgaagcctggctcagcgcgctcaaaagcagctacaccacgcacgagcagcgcgcgctgcacaaccgggacggcggcgaccgccctcccgggcctagcgacatcaccttcttctgaatcactgggaacgcggcagatggccaagaccatattgatagtcgacgactccaccaccttgcggcaggtggtgagaatgaccttggccggcgccggctatgaagtgctggaggccggaaacggcaaggaggcactggacatcctggatgggcgcaaaatccatctgatcatctccgacgtcaacatgccgctgctggacggcatcggcctgctcaagcacatcaagcagctgtccagctacaagttcaccccggtgatcatgctgaccaccgagtcggccgaagagaaaaagcgcgaaggcaaggaggccggcgccaaagcctgggtggtcaagcccttccaacccccggtgctgctgacggcggtcgccaagctgatcctgccctgagcgggcgccgcagccaggagccgacatgccgcttgcgatccgcgccggccacgagcaaaccatctaccaggcggcccagttgcgcgcgcagttggccggcgcgctgcgggacggcgccggcgttacgctggacttgtcggccgtggaggagatcgactgcgccggcgcccaggtcctgctatggctgcagcgcgaaggcatccgcctgggacagccggtggcgctgctgtcgcccagccgggccgtgcgcgactttgtccagctgatggggctgcagcgcgaactgcggctggagccctgactagaggagaggcgatggatctggaacaggcgctgcaaaccttcctggaggaatcgcgcgaactgctggccgacatggaaagcaccctgctggacatcgaggccgaacatgccgacgccgagcagctgaacgcgctgttccgcgccatgcacaccatcaagggctccgccggcctgttcggcctggaggaaatcgtcaatttcacccaccaggcggaaaacctgctggatcaactgcgcgacggccacctgaggctggacgacgagctggtcggcctgctgctgcgctgccacgaccatgtgaagctgatgatacaggcgctggccgccaagcaggatctgacggcgctgcgcgacgaaggcttgctggcggcgctgcgggactacctggcgcatccgcaggcgccgcccgcggccgactctgccgacattgagccgccgccggcgccggccagcagccgctggctgctatcgctgcgtttcggccccgacgcgctgcgcaacggcctcgatccctcgtccttcatccgctatctggcctcgataggccggatcgagcagatcgaggccatctgctgcgcgctgcctgacggcgacgccttcgaccccgaatccaactatctgcggctggaggcgctgtatcacggcgagcaggatgagaaaagcctgctggacgtattcgaattcgcgcgcgaagacagcgccatccatctctggccgctggcgctcgtccagcccagcctgcccgacgcctgcgcgaacgccggcgccgaagagacggcggcggtgcggcaggcctggacgcgcttcggcgttctggagcccatcgacgcggcggctgacgcccagcccgaaccgcccggccatgccccgctcccggcggccgccgaaaccgcagcggacggcgaagcccgcagcgccaaaccggcggagagccgtttcatcaaagtggaggccggcaagctggacaacctgatcaatctgatcggcgagctggtgatcgccggcgcggcggccaacctgatcgcccgccgcgcacagcaaacgccgctggtggaggcgacgctgaccatcgccagcctgatcgagcagatccgcgccggcacgctgtcgatgcggatggtgcagataggcgagatcttccagcgcttcccgcgggtggttcgcgatgtgtcgcgcgagctgggcaaggacatccacctgcacatcgtcggcgccgaaaccgaactggacaagtccatggtggaaaaactgggcgatcccttgctgcacatcgtgcgcaacgccatcgaccacggcatagaggccaccgatctgcgccaggcccacggcaagccggcccagggcaacctctggctcaacgcctatcacgaatccggcagcgtggtgatcgaggtggccgacgacggcggcggcctggaccggcggcgcatcctggccaaggcgcgcgaacgcggcctgctgggcccggacgacgagccgcctgacagcgcggtgttccagcaaatcttcgcggcgggcttctccaccgcggaacaggtgaccaatctgtccggacgcggcgtcggcatggacgtcgtcagacgcagcatccagcagctgcacggcacgatagacatcgacagcgagcccggccgcggcaccaccttccgcatccgcctgccgctgacgctggccatcatcgacggcttcctggtggaagtggccgcctccaccttcgtgctgccgctggaagcggtggtggaatgcatagaactgccggacggcctgcctgccaacggcgtgcacgactggatcaatctgcgcggcgagctgctgccgctgctgcacctgtcgtcctttttcgaactgcccgccaaggccgcgccgcgccgcaacgtggtggtggtccactacgacgaccgcaaggcgggcctggtggtggatgcgctgcaaggcgaattccagaccgtgatcaaaccgctgggcgcgttgttcagcacgctgaaggccatcagcggctccaccatactgggcagcggcgaggtggcgctgatcctggacgtgccgtcgctgctccgccatgcctgccgcaaggaggctgagcattttccgccgcccgatggcgcggcggcccgctcccacgccccgctgccgggaaacgcgcgatgaccgccttctccggcatgcgcatcgccacccggcaggcgctgggctacggcgccgtcatcctgctgatgctgctgtgcatcgcggtggcgctgcagggtttcggcaatatcaacagcgccgtccacaacatcacccgggtcaacaatgtcgaagcccgcctcgcccaccaactgctggagtccaaccagctggcgcggctcgaaatacgcaacggcctgctggccagcaaccgcggcgagctggaacgcgccggacggaatctgcaggacgcgctgcgccgctaccaggaagccgagcggcaactggcgcagatgttccagcgcgaagccggcaccaacgcgcgcgagcgggagctgatggccgccatccagaacggcagccgcgacgcccatcaggattacctgcaggcgctggcgctggtcggacagcagaaaccccgcgacgcgcgcgcgctgctggccggcaagggcggccggctgaacgagcagatcagcgcgttggccgatgtcgaagacggactcaacgaggagctggcgcggcaaagcgcggccgcctaccaggccagccgcggccggatgctgctgctggccgcgctggcggtcgccgccagcctgctgatcgccgccgccatccgccgcaatctgctgcgcacgctgggcggcgagccgcaggcggtggccggcgtgatgcgcgaagtggccaacggcaacctgcagtgcggcatcgcgctgcgccccgacgatcagaccagcctggccgcctccatcgcccaaaccatccagacgctgggcgccatcatcggcgaggtgaagaacggctcggaaagcctgtccgtcgcctcccagcacatccacgccacctcgcagatgctggcgcgctccgccagcgagcaagccgcaggcctggagcagacctcgtcgtcggtcgcgcagatgtcggcgtcgatcaaccagaccaacgacaacgcccggctgacggaaagcatggcggaaaaggcgtcgcgggaggccggccagggcggcgaggcggtgcagcagaccatacgcgcgatgcgcgagatcgccgagcggatcggcatcatcgacgacatcgcctaccaaaccaacttgctggcgctgaacgccgccatcgaggccgcccgcgccggcgagcacggcaaaggcttcgcggtggtggcggccgaagttcgcaagctggccgaaagcagccaggtcgcggcgcgggaaatcggcgcgctggcgcgcgacagcgtgctgctggtggacgaagccggcggcctgctggaagagatagtccgctccagccgccgcacctcggacctggtgcaggaaatcgccgccgcgtccaacgagcagtcggacggcgtcggccagatcagcctggcggtgcagcagctgaaccagaccacccagcagaacgccagcgccagcgaggaattggccgccaccgccgaggaaatgaaccgccaggccgaaaacctgcacgacctgatcggcttctttcatctgggcgccctgcgcgccggcgtggacgcgcgcgggacgccggcggcgccggaagccgccgcgcgcggccgaatgccattctgaaccggcgggagacatcaatatggccgcactcaatatcctgcgccgcgccgatagcgacgccgccgaagcggaagcggcggaactccggcagttcctgacattccagctggcgggggaaaccttcgccatcggcattttgcggatacgggaaatcctcgaatacatccggccgacctcggtgccgctgatgccgccgttcatccgcggcgtgatgaacctgcgcggcgcggtggtgccggtgatagacctgtcgctgcgcttcgcccgcgacgaaaccgcgatccaccgccgcacctgcatcgtcatcatggaagtggagcatgaggagcagtggcagttgatcggcgtgctggtggacgccgtgcacgaggtgctggcgattcccgacgacgccatcgagccgccgccgcagttcggcagcaagatccgcgtcgacttcatcgagggcatggcccggctggacgaccacttcgtggtgctgctgaacgtggacaaggtgctgtcggtgcacgagatgtcgctgctgtcggagctgagccggcaggaagaggcggaggaggaatgatgacggcacgccatgcgcgccggcaaaccggcgacggccgcggagaatcccgatgaagcatttcagcattcgacaccagttcatcctgctgaccaccggcgtgctgctgggcctgggctgcctgaccgccaccgcctggcagggcttgcgcacggtgatgatcaacggcgacatgtaccgccaggtggtgcttggcaaggacttcatcaacgacctggatccgccgacgctggagctgcaagccagcttcctgctggccaaccagctgcgcggcgccatggatccatccatccgccagcaactgctcaaccagatgcaggcgcaacgcgccgaattctacgacgggctgaaaaaatgggaagccaatccgttgccggccgagatgcgcgccaccctggcgcaaaaggtgcagcccagcggcgacgccttcttccaggaagtggacacccgcttcctgccggcgctggacgcgcacgaccaactggccatcaatctgtccttcgaccggctggccgcccagtacgaccgcaaccatcagaccatcctgccgctgatcgaacaaaccagccggatgcaacggcagatggaggacgaagcgcagcgcatcaccagccagaccttcgcctggctggccggcgtcagcctgacggtgctgttgctgctggccggcttcctgctgctgatctaccgccagctgatccgccggctgggcggcgagccccgcgacgtggcgcgcgccacccgcgaggtggccgcgggccggctggacatcgagctggcgccggcgccggaaggcagcctcagcgaagcgatacggctgatgtgcctgcaattgcgggcgatcatcggcgaagtgaagaccgcctccgacggcgtggccagcgccgcgcagcagatcagctccaccgcgctggcgctgtcgcagggagccagctcttccgccgccggcctggagcaaagctcggcctcgatagagcaggtatcggcgtcgatcaaccagaccagcgacaactcccacaccaccgaagcgatcgccgaacaggcctcggctgaagccaccgaaggcggccaggcggtgcagcagacggtgcaggcgatgcgccagatcgccgaccgggtgggcatcatcgatgaaatcgcctaccagaccaacctgttggcgctgaacgccgccatcgaggccgcccgcgccggcaagcacggcgccggcttcgcggtggtggcggccgaagtgcgcaggctggccgaacgcagccaggtggcggcgcaggaaataggcgagctggccgagcgcagcgtcgccgtggccgagcacgccgggcggctgctgaaggagatcgtccgctccagcggccgcaccgccgacctggtgcaggagatcgccgccgccaccaaggagcaggccggcggcatcggccagatcaaccaggctatcctgcacctgaaccactccacccagcagaacgccgccgccagcgaggagcttgcctcgacggccgaggaaatgacccagcaggccaaccggctgcagcaggcaatggatttcttccggctggcggccagcaccgccgccctgcccgttgcggccgcgcccgcagcccgcgcagactcggcgcctccgccggccgagcctccggcccacgatcaggaacagctggacgacatgttccgcttttgaaagccgcgcgcggcgcgggcgcactgtactagattgaaacatgtgaatgtcgccggcagtccgcccggcgctgattaaggaaagccaagaccatggcattgactccgccgctaccggcggcggcgcccgcgcccgacagccggccaagcgcaacggcggccgccgacgccgccggcgacgccatcttcctccacccaggcgactggcacttcggcggccgcggcacccgcatccgcacgctgctgggttcctgcgtctccatcatcctctggcatccccaggcccaggtgggcggcatgtgccactacctgctggcccagcgcaccaaccgccgcggcgaagccctgtccggccgctacggcgacgaggccatgctgctgctgctgcgcgaaatcctggcctgcggcctgccgctgcaggagttccacgcccggctgataggcggcgcctcgatgctgatcagccgcgaacgcaaactcacccatgacgtgccggcgcgcaacatcagcctggcgcgcgccatggtcaagcagcttggcctgcgcctgcaggcggaagacctgggcggcaactgtccgcgcctggtgttgttcgatgtcgccagcggcaacgtctggatcaagcaatcgcaagaggccgagctggaactggttccgcccaaaaatacaaggatgcgaacatgagtatcaaggttctgatcgtagacgactccgccgtggtccggcaggtgctaagccaggtgttcaccgaggccagcggcatagaggtgatggatgtcgccaacgatccctacatggcgatggacaagatgaagctgcgctggcccgacgtggtggtgctggacgtggaaatgccgcgcatggacggcatcaccttcctcaagcagctgatgagcagccgccccaccccggtggtgatctgctcgtcgctgacgcaaaagggcaccgacatcagcatgcaggcgatggcggcgggcgcggtggaggtgatcgccaaaccgacttccggcgtcaagggcttcctggaggaaagctcggcccagctggtgatggcggtgcgcagcgccgccgccgcgcggatgaaccgggtgcgggtgatgccgtcggccagcggctcgcccacggccgcgccgtccggctccaatccgctggaaacccgtcccaagctgtcggccgacgccatcctgtccgcgcccaccggcagcaatgtcttcgccaccaccgagcgcatcatcgccatcggcacctccaccggcggcacccaggcgctggaaaccgtgctgaccgagctgccgcgcacctgtcccggcctcgccatcgtccagcacatgccggagaaattcacccgctccttcgccgaacggctgaacagcctgtcgcagatagaggtgaaggaagccagcaacggcgaccggatcctgcccggccgcgcgctgatcgcccccggcggcaagcacatgatggtcaagcgcagcggcgccttctaccaggtggaagtcgtcgacggcccgctggtcagccgccacaagccgtcggtggacgtgctgttccgctccgccgccaagttcgccggcaagaacgcgctgggcatcatcatgaccggcatgggcgacgacggcgccaagggcctgaaggaaatgcacgactgcggcgccaaaaccatcgcccaggacgaagaaagctgcgtggtgttcggcatgcccaaggaagcgatcaagctgggcgccgccgacgaagtgatggcgctggacatgatagccaaggccatctgccgctgatcgggccgcccatggaactggacgacatcctggtgatcgacgacagcaaggtgcagcgccagcatgcgctggaactgtgccgcgcgctgggcgccgccagcgtgcgcgaggccgccgacggcgggcaagggctggccatgatgcgggagcgcctccccagcctggtgctgctggatctggagatgcccggcatggacggcgtgcgggtgatgcagggcatggccgcctccggcctgcacacgccagtggtggtcgcctccagcaaggactacctgctgatttccacagtggagatgatgggccgcgagctgggcctgccggtgctgggcgcgctgcaaaaaccgctgcggctggatgcgctgcgcgacctggcgcaaagagcctggacgccggatgcgcggatggacggccgcgagttcgcgccggcggagttgcgcgcggcactggacgcggaccagatccgccccagctaccagcccaaggtcgatctggccgacggcgcgctcaaaggcgccgaggtgctggccagttggcggcacccgcaactgggcgcaatcgacgccgacagctttctgccggtcatagaacaatccggctgggccaccgaactgaccatgcagatgctgacacaaggcttggggcaatggcgggaatgggcgcgccagggtctgcgcctgccgctgtccctcaatctggagccgcgctcgctgcaagaggatggcctggtcgagcagatcgagcgcatcatcgccgacagccatgtgccggtccgcttcatcagcttcgaagtgacggaaaccgcgatcgcggacaatctgtcgcgggcgataggctgcgccgtgcgcttgcgcatggccggagtaggcctggcggtggacaatttcggcaccggcttcgccgccatgcagcagctggagcgctttccattcaccgaattgaaaatcgacccctcgctggtgacctcgatcggcggcaaaccccatctgcaagcggtgctcaacagcatcgtcgagctggcgcgccggctgaagctggcgacggtggccgagggcgtgcaaagccaggaagactgccagttgatggccgagcgcggctgccagctgggccagggccgctatttcgccgaagcgctgccgccggacgaactcctggactggagccgcgcccgcaccgccgcggcgtctaaatgaaagctcagcaagaccacagcggcggctcgtccatcagcgcgatctgctctcgcagcgccaggatctgctcctcccaatagcgctggccgccaaaccacgggaaggctgccggaaacgcgggatcgtgccagcgccgcgccagccaggcgctgtaatggatcagccgcagcgtgcgcaggccttccagcaaatagagctcgcgcgtgtcgaactcgcagaagtcttcatagccggccagcacctcggccagttgccgcgactgctcggcgcgctcgccggacagcagcatccacaagtcctgcaccgccggccccatgcggctgtcgtcgaaatcgacgaaatgcgggccggcgtcggtccacagcaggttgccgacatggcagtcgccatgcaggcgcaactggctcgcctggcccgcccgctcgaagcagcgcgccaccccttccaaggcctgctccaacacgccgcggtagacattgcccagctccggcggcagccatccgccctgcagcagaaagtccgccggctcgcggccgaagctttgctggtccagcgtcgggcggctgcggtaatcctccacccgtcccagcgcgtggatgcggccgaggaaacggcctatccactgcaaggtgtcgtcgcggtccagttccggcacccggccgccgcggcgctcgaacagcgcgaaacggaagccgccgtgttcgtgcagcgtgcgtccctgcagccgcaacggcggcaccgccggaatttcgcgctcggccaattgccaggagaaggcgtgctcctccaggatggcgtcgtcgctccagcgctgcggccggtaaaacttggccaccagcggcgcgccgtcgtcgatgccgacctggtagacgcggttttcatagctgttcaaggccagcaggctgccgctggcgcgcaggcccaggctctcgaccgcgtcgagaatggcgtccggcgtcagcgcggcgaaagggggaggcaaggtggtatccatccgccgattatacgcgcaacgaggccggcgttcagcgcggcagataaacccgcaaacgcccgcgccatctgctaagcctaaagtgaaaaccgtcggcgcaggaaaggaaagccatgaaaccgcacctcccccctctttccttccacctcgatggagaccagctgcggcacggctccgagcgttgggccaacctgactttgcaaggctggctggtgctgctggaccgcggcgcccgccgccaggcctggcggcgcctgcttgaacaccggttaaacacgcggcagctgctgcaaggcttcgcctgctggctgagcggcagcttggtgctgctcgcgctggcctacctgctctatctggtttccacgcgctggtaatccccttgtccgggcagggactctgcagctcattctcgttttcattatcatttacttttgcaatcaacttttaatgaccaatagcgaaaataatgagaaaatggcggctgtcccccctagaccggaagtccgcgatgaaacacccacacgcaacagaaagcggagacagcgctgaacgccagaaaaccgcgcgcgccagcacgctggtcagcgtggcggtcaatgtgctgctgtcggcattgcagatcatcgccggcgtctgggcccattcctccgcgctgatagccgacggcatccactcgctgtccgacctgctgtccgacttcgtcgtgctggtcgccggccgccacagcggcaagggtcccgaccacgaccatcagtacggccatcagcgctacgaaaacgccgcctcgctggccctgggcctgctgctgctggccgtcggcgccggcatgctgtattcggcagccaacaaattcatccaccccgccgatattccggcagtccacagcctggccttgtggatcgccgcgctggcgctggtcgccaaggaaagcctgttccgctacatgttggccgccgcgcagaaagtgcgctccagcctgctggtggccaatgcctggcatgcgcgctccgacgccgcctcctcgctggtggtggccgccggcgtggcgggcaatctgctgggctatccgatactggatccggtggcggcgctggtggtgggcctgctggtcggccgcatgggttggcgcttcgcctgggacgcgctgagcgacctgatggatcgcgccgccagcgaggacgacatcgccgccattcgcgccaccttgctcgccaccccgggcatcgtcggcatccacgatttgcgcacccgcaaaatgggagacatgatcctggtcgacgtgcacctggaagtggacggcaacatcaatgtctaccaggcccacgccatcaccgaagaagcgcagcagcgcgtgctgcgccagcaccctgtgctggacgtgatgacccacgtcgacccggccgagcattaccgcgacggcaacatgcccgttgccggttaagcgcgcgcaggcgcgatatttcagataaaagcagccgccaaatagccttgtcggctgcttttgtacgtaaatgaagtttttacgtgcaacttttccatagtcggcgtagtctacacatactatgacgataccatttcaatccattccgcgctggctgctgcacgccctgctgttgctgccgctgctgtggcagtttgaaaactacgccgtcagccgcgcgccgttcaacggcaacccccagcctgccaccatcagcacctggaccgaacactggccggcggacacgcctttcctgctggtgcaggaagtgcgcgaccagctgcgccacgccgacgccaaacgcgatgccggcacgccggtgcgcgatgtcgccgccatgccgcgccccagcgacgccagctgagcgcccccccggttttgaatgcgaaatgccggccacaggccggcattttctttgcgcgcgcggcttacagcgacgcgcttggctgcgggtggcagatcgggcagccgggattgctgcagtggatcgaactattgtgcaccagcgcgcgcagccggctcagcctgtcggcctcgccttgcgctccctgcttgccctgcgccaggctggcgctgccgtggctgtccagcgtcggcgcgcccgccgacatcggcagcggcgaggcctggcaaatcgcgccgactcccagcatcgcgccccccgcgcccagcgcggcgatccattttcttttcatcgtcgactctcctgtgccggccatggcgccggcaggtctcatccctgcaagattagcgcaacgacagccaaaacaaaccccgccggcggcggggtttgttaacaaacttagcggatgatttccaccttgtagcgcggcggcaacaacaatgccggaacctcgcgccgggccttgcggttgcgcctggcgggacgggcctgcttcaggccttcgccattgccggttagcgccggaacttcgcgttcgcgttcgcgcatggctgcgggctcgcggtcgccgccctgttcgcgttcacgcgcggccggcttggcgcgcgcaggcggctgcgccggcatgaagctgtccacgctttgcggcgtcagcgtctggcgggtcagcttttcgatcgcctcgtgctggcgggtttcatcggggctcatcagcgagatggccacgcccttggcgccggcccggccggtgcggccgatgcggtgcacgtagtcttccggggagttcggcatttcgtagttgaccacgtagggcagctcggaaatgtcgaggccgcgcgccgccacgtcggtggcgaccagcacgcgcagttcgccgtccttgaacgacgccagcgtctccaggcgagcgccctgcgtcttgtcgccgtggatggcctcggcatccaggccatcgcgcttcaggtcgcgcgccagttggtcggcgctgatcttggtcttgcagaacacgatcacctgactcatgtcgcgcgcgcggatcagttgcgccagcacctggcgcttacggaaggcgtccaccttgaacaccagctgctccacctggtcgttggtggcgttctggcgcgccacctcgaccgtctgcggcgaatgcatgaaatcggcggccagacgcttgatctccggcgcgaacgtcgccgagaacagcagcgtctggcgctccttgggcagcagccccatgatcttgcggatatcctggatgaagcccatgtccagcatgcggtcggcctcatccagcaccagcacttccaccttgcccagctgcacgttcttctgctggatgtggtcgagcaggcggcctggcgtcgcgatcaggatttccacgccgcggcgcagctcctgggtttgcggatccatattcatgccgccgtagacggtggtcgcgcgcagcggcagatacttggtatagcttttgacgttctcgccgatctggtcggccagctcgcgggtcggcgaaatcaccagcgcgcgcaccgggtgcatcgccggcgacacgctggtattggcgaatttcttcaagcgctccaggataggcagcatgaaggccgcggtcttgccggtgccggtctgcgcggcggccagcaggtcgcggccggacagcaccagcgggattgccttcccctggatcggcgtcggctggctatagccctgctcttcgatggcgcgcaggatttccggcgacaggccgagttcggaaaacaacatgtaacacactcctgcaatacgtaggggcacgttgcggtctatccgtcaacgcgccccgatgttcattaagtaaaccggcggcagataaaatcaaatgccgcccggggcgggcggcagctccatcgtcagcccatatggctggccacgctgatcaacagggtgacggccagccacagcagcgccgaacgccataccaggccgaccgcgcttttcaggaaactgggatcggcatcgtcgcccaggcccagctccggccggtatttcaccgaatagtcctgccgcagcgggtcgcccagcttcacgcccaacgcgccggcggcagacgccagcaggatgccgttggcgtagttgccccaagtcctggcttgcgaacgccagcaatagatcgcgtcttcaaagtcgcccatgatggcgaaagccgccgccgtcagccggacgggaatccagtccagccaggccgccgcgcgcgcggcgaacacgccgaacgggtcttccgcggcattgcggctgccccacttctggttcagcatcgaacacaggcggaacaacaacgctcccgacggccccggcagcaccacgaaccagaacatggtgccgaacacatggcggtagctgtccagcacgccttgctcgatcgccagccgcgagatctcctctaccgacagctccgccgtcggcaggccggtccagttggacagcgccactctcgcatccagatcccggccctcggccaatgcttgcgatatctcggaaaatgcgctggagaaatggcggaagcccatggtcagatacagcaccagcacattgagcgccagcgccagcagcgggctcgcggctttcagcgaatagaacagcaacaggctgagcagcagcaccggcacgatggcgaccagccaggccagcacgccatggcgctcggcgccggcattcaggttgcgctcaagatggttagcgtagcgggtgaacaacaaccacacccggttgcgattgccgagcggtcgcagttgctccaaagccagagcgagaatcagggaaatcagggtcatggtttctggatgtgattttcacgggaccgctggggaagataccataaaggcgctcgccccgcccaccgaagtgatgccggcgcgccgccaaaatggcgaaaggcgcccgatgggcgcccttgcggactgtttgagcggccggatcaagccgaacccagcaggcggcggcctgtcaccacctccggctggttgccgccgcggtcatagcccagcgtggacgccgcggcagtgcgcagcaccagcaacgactcctccaccatggccagccgctcgctgacgaaactgccgttcagctgattgatgctttgcgcccggttgaccgcgtcctcaagactggtccaggcctcgcaggccggaggcttgtccgccagccagatatacagcgtgtcgcggtcctgcacgcccagcgtggtcatcagccggccgcggacggaggactgccgcgccagttcgtcgagcacggcgctcttgttgtcggccagcgcctccagcttgtgctcctcgccctgtatcagcagggcctgctcctgctccagcaaaacgacaagccgggacacgaggtcggcctcgtcccggcaaagctgtgcgaactcatcaatgacagacatatccctgcttctttgcgctgcttgtccacttccggctcaggctcaaccctgcaacagctcctgggccgatgaaatcaggccgtcggcgatcttgtccggattgatgctgaagctgccattggcgatggccgacttgatcgattcgaccttggccgcatcgaaggccggctgctggctgggatcattgccgatggcgctcagacggctggcgacggaattgatctgcacgctgtcgctgctgctgccttggctgctggtcgaactggacggcgcacgggcagtggtcttgctctgggtgctgtaggttcccgacagcttgcccgaattgtcgatcttcatggcctggccttcccgtagctaatctcaactgatcctattatcgaccgaaaaaacaatctcttgaactattttctcatcaaaaaatcacggccacgctgccatcggcctgcacggtgccccgcaccaccctgccgctgctcaatctgaccatcacctgctcgccctgggcggcgttgcccatcgccatgccctcggcttcggcggaaaagccgtcgccctgcgccagcaccttcacctgctggttgctgcgcaccagatacggcgcgcgcaccatgaaagtgcgcagccacgcgcccgccggcgcgccggtccgcaacacctggccgaccgccaggttgagatcgtccagcacattgctcgccagcgcggggttggcgatatccaccaaccggacgtcggcggcgcctatcgtctcgccggcggccatcggccggctcagcgccacgcccatccgcttttcattgatgctgaccggaatccgcagcgaccagcccagatccgggcaggacaccgcgacgaaagtcgctccggtggtgacgcccggcgtcgcccaatccgccttgggacggctgcaggcgggcagcgccagcctcctgtccaactgtcccagccgccaggtggcggcgcgcaactccagctcatgcttgagaaactgatcggccagccgctccagctggaccaggttctggatgccgtcggcacaggccggcatggccgccaacaagccgcaaaaccacaaaattgatcttcgcatccctgcattttagcgcaaggcgagccaatgcagcgatggcgattgacaagcgccggcaagattcgaataatcgtttgaatagagcttagactcttgacactaaataatacgcaaacataaatcgttcgcccgaggagaaacacaatgcgtagtcgcttgaccgctctcgccctggccaccgcccttgccctgccggccgcagccaacgcttacagcaacatctattactttggggacagcctgtccgatgtcggcgccttcggcggccaatccggcctgcccgccggcgcccgctggaccaccggctacggtcccaactggaccaatgtgctgagcggccatttcggcctgcaatcagtcgccaacaacccgctcaacgccactaccagcagcagcggcaacaactatgcccagggcggcgccgtcgcccaaacctaccaggccatcacccagtatcccaacacctccggcagcagcggctctgtcgagcaatacggcccgggcggcaccctgctgatccaggaactgccgcaacagaccgcggcctatctcgccagcaccggcggcaaggctgatccgaacgccgtttattcggtctggatcggcggcaacgacgtgatcgccgcgcttggcacggcctccagcaccagcggccagcaactgctcggcgcttcggcccagtacaccgccgccagcgtgcaggccttggtcaaggccggcgccaaaaacgtcatcgtgcccaaccttcccaatatgggcgccgcgccgctggcgatttacgcttcgctgaccgcagtccagcaaaccgtcaacgcgcaggttccaggcctcgtcaccaccaccgcggtcaacaacgcctgggtagcggcctggcaagtcatcagcgcgcagaatgtcggccccagcaattccgccgccgtcatccaggccgcgctgaccgccgccaacacctcgctctccaccgccaccggcggcgcggtgccggccggcagcgtggccaccgcctacaatggcaacggcacggctgccaaccccggcgtccagcccagcctgcagcaattggccgccggctacaaccagctcaccgacatgacgctgtccggcgccggcgtgcagcacaatatcgttcgcccgaatatctcgctgctgttccaggaaatcctggccaaccccggtcaatacggcttcaccaataccatcggctccgcctgcgccacctccgccatccagtgcgcggccaatacgctgcctggccaaagctacgtcttcaccgaccagctgcaccccactccggcggcccagcaaatcatcggcgactacgtctacggcctgcttcaagcgccttactacgccgcggcgctgcctgactccgccttgaacaacgcccgccagctgggcggcgcgctggacagccgctaccaggccatccgctcgcaaaaacgcgcggtcggcaccgtcagcgcctttgtcgacggcgccttcaacgacgacaagatcggctacaacaacctggccgccaaaccgaagggccagctgtacacgctgggcctcgactaccaggccagcccggcgctgagcataggcgtggcgatgtcgcgccagcagggcaagaccgacatctccagcacaggcaccccgggcagcgtggacgaccgcaccacgctgatgtccggcctggtcagctacaaccaggacaagttctggatcgacggcgacgttcacatcggctccggcgatctggacaccagccgcgccgtcaccctggggccgacccaggtgcagatcaacggcagcacccgccagacccagtacggcctgcgcatcggcggcggctaccggctgcagtacggcaacttcaccaccggcccggtggccggcctcgactacgcccacgtcaaggtggccggcttcgccgagcaaggcggcagcagcagcatggccttcggcggccagaacgccagctcgctggtgggacgcgtcggctggcagcttgacgccgacgtcggcaagttcagcccctacgccaaggtgagcttcgcccacgagttccagcaagacgaccgcaacatcaccgccggcctcaccagcacgctgggcgactggaccaccaacatcggcaaggcggacgccaactggatggagtggaccgccggcgtcagcgccaacttcagcaaaaccgtcaccgcctacggccagttctcggtcaccagcggcaggagcggcggcaatcagaccggcggcaacctcggcgtggccgtgtcgttctgatcgttgcagccataacgaaacaggctcccgagggagcctgtttttttgcctgaacggcgcggagcggatcagcccagcgccttctccatcaacgccttcacctggccggcatccgctggcaaggtcactacccgctgcggcagcgactccagacgctcgaagcccgccggacgcggcggttcgcggtccagcgcctcgcgtatggtttcggcgaacttggccggcagcgcggtttccaggcacaccacggtttcgccttcgcggcgcagttcgcgcgccaccttgatgccgtcggcggtatgggtgtccaccaccacgccatcgtcggcgtccaccaggcggatggtggcgatgcggtcggcatgcgcgcttttgccggagacgaagccgaacgcgtcgcgcacctggcgcatggtttctccatccagctggaaaccgccgcccgcgtccacctcggcccacaattgcttcaccttcgccccgtcgcggccgaccaggtcgaacacgaaacgctcgaagttggatgccttggaaatgtccatcgacgggctggaggtgacgtaggtgcgctcgctgccgcgcggcgcgtagcggccgctcttgaagaactcatccagcacgtcgttttcattggtggcgacgatcagtcgctccaccggcaggcccatctgccgcgccacgtggccggcgcagacattgccgaaattgccggacggcacgcagaagcttacggtttcgtcattgctggccgtcgcgcggaaatagccgtggaagtagtacaccacctgggcgacgacgcgggcccagttgatcgagttgacggtgccgatcttgtgccgcgctttgaaaacgtggtcgttctgcaccgccttcactatgtcctggcagtcgtcgaacatgccctggatggcgatgttgtggatgttctcgtcctgcaggctgtacatctgcgcgcgctggaaagcgctcatcttgccgtccgggctcagcatgaacacattgatgccgcgcttgccgcgcatcgcgtattcggcggcggagccggtgtcgccggaagtggcgcccagaatgttcagcttctcgccgcgcttctccagcacatattcgaacagctggccgaggaactgcatcgccatgtccttgaacgccagcgtcgggccattggacagctccaggatggccaggccgtcatgcaggcgcttgagcggcgcgatggcttcgctgccgaaggtctcggcccggtaggcgcgcgaaacgatgcctttcagatcatccgccggaatgtcgtcggcgaacaggcggatgatctcgaacgccagctcggcgtagcccagctgccgccaggcgtccagcgtggcgcggtctatccggggatagcgctccggcagcagcaggccgccgtccggcgccaggcccatcagcacggtttcgcaaaacggcagcggcgccatgccgccgcgggtactgacatatttcattgctgtggttccaggtattggccgcaggcggcggaggcttccttcaggcgctgcttgccgcgcggatcgtctttcttgatctggccggtcaccacgcccatcacctcttccgcggtgaaagtgctggccagcttctcgctggcgcactggcagtagcgctgcacctgctcgttgccgggcaggccgacgccgtcggacgccggcgtgcgcttgacgcagccgcgcatcaagaagccctgcagcagctggtgctggccggggctgagcggcgtggccgccgcgaaaccggtgaagagcgcggcgcacaggccggcttgccaatgcctagtcattcaattcttccatgcgcagtcgcaccaccttgccggccacgctgtccagcgcttcgatgccggcgatggcatggttgatcgccttctcctgcacccggtgggtgaggatcaccacttcggcggtgccgtcggacaccgagcctttctggatcagcgcttcgatcgagatgccgttctcggccaacagccgggtgatgctggccagcacgccggcgcggtctatcgcgccgatgcgcagatagtaggagctggtgacctcggagatcggcagaatcggcaagtcctgcaactggtccggctggaaggccaggtgcggcacccggtgttccggatcggaggtcagcaggcgggtgacgtcgacgatgtcggccaccaccgcggaggccgtgggcaaagccccggcgccggcgccgtagtacaaggtcggccccaacgcgtcgcctttgaccagcaccgcgttcatcacgccgttgacattggcgatcagccggccttccgggatcagcgtcgggtgcacgcgcaactccacgccgctgtcggtgcggcgagtcaggcccagcagcttgacgcggtagcccagttcctcggcgtagcggatgtcgcggccgtccagctggctgatgccttccagatagcactggtcgaactgcatcggaatgccgaaggccagcgccgccatgatggtcagcttgtggccggcgtcatggccctcgatgtcgaaagtggggtccgcctcggcataacccagcttctgcgcttcggccagcacgtcggcgaagctggcgcccttgtcgcgcatctcggtcaggatgaaattggaggtgccgttgatgatgccggcgatccactcgatgcggttggccgccaggccttcgcgcagggtcttgatgatggggatgccgccggccaccgccgcttcgaacgccaccatcacgcccttttcctgcgcgcgggcgaagatctcggtgccgtgcagcgccagcagctttttgttggcggtgaccacgtgcttgccgttctcgatcgccttcagcaccagctccttggcgatggtgtcgccgccgatcagctccaccacgatgtcgacgtccgggttgtcgacgatccgccgcgcgtcgtccaccagcgccacctccggtcccagcacggcgcgcgccttggccaggtcgcggctggcagcctggatcaggcgaatctcgcggccggcgcggcgggtaatctcgccggcgttgcgcttcagcacggtggcggtgccgccgccgacggtgccgacgcccagcaggccgatatggatcggtttcataaatctgtctccgttcagtcccttgattttttattcaggccaaaggccgtctggacaggcgcgtcctgtccgggcggtcctcgggcggcgggaatctgtcccgccgccgctgccggcgcttagtcggcgctgccgtgacgcttgcggtagttctccaggaaacgggcgatgcggccgatggcctccaccagatcatccgtattaggaaggaataccacgcggaagtgatccggcgcaatccagttgaagccgctgccctgcaccagcagcaccttttcctgctgcagcaattccaggatgaattgctggtcgtcgcccaccggatagatcttgggatcgagcttggggaacaggtaaagcgcgccctgcggcttgacgcaggacacgcccggaatatcggtcagcagcttgtaggccaggtcgcgctggcgcgccagccggccgcccggcgccaccaggtcgtctatgctctggtagccgcccagcgcggtctggatcgcgtactgcgccggcacgttggcgcacagccgcatcgaggccagcatgttcaggccttcgatgtagtccttggcgtgcttcttctcgccggacagcaccatccagccggcgcggtagccgcaggcgcggtaattcttcgacagcccgttgaaggtgacaacgaacaagtccggcgccagcgagcctatcgaggtgtggctggcggcgtcgtacagcaccttgtcatagatttcgtcggcgtagatgatcagctgatgctggcgcgccacctcgacgatctgctgcagcagcgccggcgggtacaccgcgccggtcgggttgttgggattgatgatgacgatggcacgggtcgacggcgtgatcttggcctggatgtcggcgatactggggaaccagccctgctcctcgtcgcacaggtagtgcacggccttgccgccggccagccccaccgcggcggtccacagcgggtagtccggcgcgggcaccagcacttcgtcgccattgtccagcagcgcctgcatcgccatcacgatcagctcggacacgccgttgccgacgatgatgtcgtccatcgccacattgggcagatgcttctgctgcgcgtaatgcatgatggccttgcgcgccgcgaacaggcccttggaatcggaatagcccgacgccgccggcagattgacgatcacgtcctcgatgatctcgtccggggcgaagaagccgaacggcgccggattgccgatgttcagcttgatgatgcggtggccttcgtcctccatcctcttggcgtgctcgagcaccgggccgcggatgtcgtaacagacgttggcgagtttctgcgatttgtggactggctgcatggcggcgacggcttccgtttcaggccgcccgccggatgggacggcatgcttgtggcggtgtggttgctgtttcatgggatctctgtattccgcccggcggctaaagccacattcagggcgtggtcgcttgagccccgggtctgggtataatcctatcccaatctttggtgcactgcacgagcgccgcccgatgcgccgcgcggtggccgccaaccactgccaagggagccattccgatgaaaatgcaccagtcgctgggacagggcaaaaacctgttcaccggctacggcgacggccacgtgctgatcaatgcccagcgccacgacggcaacctgatcgtcagcgccgacgaggtggccgcctgggccgcgccggacttttccggcctcgccgccgcgcacttcgacgcattgctggcctaccagccggaagtggtgctgttcggctccggcgaaagccagcgcttcgtccacccgcggctgtacgcggcgctgaccgaggccggcatcggcgtggaatgcatggacacccaggccgcctgccgcaccttcaacatcctgctggccgaagaccgccgcgtggtcgccgcgctgctggcgatctaaaccgcttcccctacccgccgcgccggctcgcggtggtaggccagcaccacggcggcggcggccagcgccaccagcgccagcaacgcgaacagcgccgcctggctccaggccaggccgatcagcaccccgcccagccacggccccagcaccgaaccgatgcggccgatgcccaggctccagcctacgccggtggcgcgcaggctggtcggataagcgctggccgccagcgcgttcaccgccggctgcgcgcctatgatgcagaagccggcgccgaacagcagcatatgcagccacagcgcctcgccttgcgccctgcccaacagccataagcccagcgcggccaacagaaagcaaggcggcagcgcgcggcgaaacccggcccggtctatccaatagccgaaggccagcgtgcctatcaccccgcccagttgcagcatgctgcccgccagcaaggcatggcgcatgtccagcccctgcgcgcgcaacagcgacggcatccagttggacaggaaatacagcacgatcagattgaggaagctcagcagccacaacagcagcgtgcgccgggccaagccgttgcggaacagctcggccaccggattgctgcgggccggccgctccgccagccatggccgaatacccgccggcagcgacggctccatcctgcgcaaccaggcctcggcctgaccggtccgatcgcgcagcagcagaaatttggccgactccggcaagccgcgccacatcggcagccacagcagcagcggcgcgacgccgccgacgatgaacaccgagcgccaaccgtgcgcgggaatcagccaggccgccagcaagccgcccagcaaggcgccggcggtgaagccgcaggaaatgagcatcatcaggctggcgcgccgccgcgccgggctgtactcgccggccagcgccatcgcgttgggcatgatgccgcccagtcccaccccggtgacaaagcgcagcgcaatcagctgcggcagattggcggcacccgcggtcagcagcatgccggcggaaaacagcagcgcgcagcccagcagcaccgggcggcggccaatgcggtcggccaaggcgccgaacagcaaggcgcccagcatcaagccaagcaagccggcgccgaacaccggccccagcgccgatttggcgatgccccagtcctccagcagcgcgggcgcgacataacccatcgcctgcacatcgaaaccgtccaggatcatgcacagcccgcacaaaaccaacagccggtactgaaacccgcccagcggccgctcgtccagccacttgcccaactccatctccatgcccgtcccttcaatatgcgaatgtcaaagcagcatcgaagaaaggcgaggatgggtcaagttgcggcgcagcacacattcaagcggatgctatccatgcatgaatgacaaagcaatggccacgccatcgcaaatcatcagttgcatccgctgcgcggataatattttaggtggcggttccgcccgccaaacaggccaggggctgtgcggccagccctgtcgctgagcgaatcgaagattcgcacgcagaggcgatcccaggccgcccctcagcccgcgaaccccggcaaaaaatgcctggccaggagccgccgaaactacatgcgtgcgcatctttgattcgctcagcggtacgcgctaacgtcgcgcggcgtcgaacaaatcggcggcttcaaacctggccagacgcttttttgccggcgcgtgccgaagggggtatggtcgccgatcagccatctacccgaacgccaaaaccggcaaacgtccgctgctttgtcgccaaagaaaatgccgctcgccaaataggcaaacggcatcgatgcagacgggctccgcccccctcctcggatcagcctcagtgcagcttcaacgccggccgcgccgcgcgccgcagcttgtcgccgatgaacagcaggatcgccagcgcccagccgtgcaccgccgcctggtgcatccggtacagcgacgcgtagatcagcttcgcgccgcggccttccacgtggtagtcgcgcttcggccccaccaccgccgccaggctgcccaccgcggtgtgcttgcccagcgacaccatcatgccctgcggcttgaagacaaacggccgcgccggcttgtcgtccagcctgcgcgccaattcgtcggccagatagcgcgcctgctggtgcgccacctgggcggtggcggccagcatgcggccgctgtcgccgtccggcgccgccgcgcagtctcccatcgcgtatacgcagtcgccgccggcgcagtgcagccgggtatccaccaccagctggttgacgcggttggtctccaggccgtccaggccggccagccagcccggagctttcaccccggccgcccacaccgtgatgtcggcgtccaccttgcggccgtctgccagcgccacgccgtccgcctccaccgccgccacccggctgttggtcagcacctggatgcgcttgccggccaactgctcctcggcgtaagccgacagcgtcgccggcgcggcggccaggatgcgctccgcgccttcgatcacgctgatcctcacccgctccggctgcagccgcgcgccgtagtggtgcaattcgcacatggtgtggttcagctcggccgccagctccacgccggtggcgccgccgccgacgatggcgatggacagcgcgcgcgccggcgcatcgccgctgctggcgcggaaagcctgctccaacacgcggtggcgcagcttttcggcgtcgttgggcgtgttcaggaacatcgcgtgctcggccacgcccggggtgccgaaatcgttggcctcggcgccgacggcgatcaccagccagtcatagcttatctcgcgctccgggcttagctgttggccgtcgctgcccggtatcgccgccaggcggatgctgcggcgcgcctggtccagcccctgcatatagccgaactcgaagtcgtagccgttgcggtagccgtgggcgaagtagttgacctcgtcctcgccggtgttcagcgcgccggtggccacttcgtgcagcagcggtttccagatatgggtgggcgagccatccaccagcacgacctgcgcgcggtggcgggcgcccagcgtgcggcccagccgggtggccagctccagccccccggccccgccgccgacgatgacgatgcgcggcagcgccgcgtttcggcttagcataagcaactccttattagtggtatttttttgccaaggttaccgcattttccccatcgccagacgccagccgcgataattagcgcgtcgccatggcagtatcgtgccgatccatcgcccgcgcgccgccgcggccaaagaaaaagccgcccattcggcgcggaatggacggcttgttcacggtcggcatggcaggtttaccacaacaccttggccagcaatcccgccagcaaaatggcgatcagcatcagcaggaaattctgccgcttctgttcgcgcatcagctggatgtagccctccaccaacagctcggtcttggccgaacccagcgcctcattcaacttgcgcggcagcgtcggcagcgtggtcgcccattgcggcgcttcattcttcagcgtgcgcagcaggccgcgccaacccacctgttcgttcatccacttggtgaggaagggcttggcggtgtcccacaagtccagctccggatccagctggcggcccaggccttcgatgttcagcagcgtcttttgcagcagcaccagctgcggctggatttccacattgaagcggcggctggtctcgaacaggcgcagcagcaccatgccgaacgaaatctggctcagcggcttttcaaagatcggttcgcacacggtgcgcaccgccgcttccagctcttcggcgcgggtatccttcggcacccagcccgattcgatgtgggcggtggcgacgcggtggtagtcgcggttgaagaaggccaggaagttgaccgccaaataatgtttgtcggtgtcggtcaggctgccgacgatgccgaaatccagcgcgatgtagcggccatccggcgcgacgaagatattgcccgggtgcatgtcggcgtggaagaagccgtggcggaacacctgggtgaagaagatctccacgccgaagcgggacagcttctgcagatccacgccggcctcgcgcaaccgctccacctgccccaccgggatgccgtgcatccactccagcgtcagcacgtcgcggctggagtagtcataaaacacttccggcacgatcagctgctgcgagcccttgaaattgcgccgcagctgcgaagcgttggccgcctcgtgcatcatgtccagctcgtcgtgcaggtatttgtcgaattcggccaccacttcgcgcggcttcaaacgcttgccgtcggagaacagcttctccacccagccggccagcgtgcgcatcaaggacagatcctgctcgatcaccggcaggatgcccggccgcagcaccttgaccgccacttcgcggccgcggctgccatcgggctggcgcagccaggccttgtgcacctgggcgaccgaggcgctggccaccggcttgaggtcgaaatcgacgaacagctcctccaccttgcgccccaggctgttttccaccacctggcgggcgatgtcgccgtcgaacggcggcacccggtcctgcagccgcgccagttcgtcggcgtactccggcggcagcaggtcgcgccgggtggacagcacctggccgaacttgacgaagatcggccccaggctctccagcgccaagcgcacccgctcgggcagcggggcgcggatgtcgcggcccaccgggcacaacgcgaacaagcggtgcaaaaaggccagtttggaatggccctcgaggaaatcgtccagaccgtagcggtacagggtggcaactatcttcagcgaacgcgatatcgacataaagtccgtcaggtcggggtattcggtttattgagcgcggcctccagccgcgccagccgcttatccagccggccggcgtcgtcgcgcagatggtccacttcggacacgaagcgctgcaccaggcggcggctggccagcaccggcgcttcctcgcgcaggtgttccacccagttttccgccaggcggaaagccagctggcccttgacgccgaacaggccgcgcgccagggtttccatccgctgcgccgccacgtcgccgaacaggcgcgacaggtcttcgcccgcatgccaatgcaactggccgacgatgcggcccagcgcggcggccagctcggcgtcgccctccagcgcgatgtcggacagttgcggcggctgcccgctcagctgcgacagcaccgcgccgtggcgcagcttcagcctagcctccggctcgccctcgcaggcggccagccagccttcgtcggtaatcaccccggccacatgcaagggcggcagcgcgatggccacgcggcggccggcatgggcggccagctcggcgcgccgcgccggatgctggtttaaaagatgattgaaggcagcgatggtcagtgccatgggtatcctcccgctaaacccgccagcgccaatgccagggctcatacagatagccgcaggcattgccgcgcggatagctcaggtgaaagccgaaagccgcggcgcggcggctcagccaggcgaaggcggcggtggtttcgaacgcttcttccagcggcggcgatcccggcgcgccgatatcgacggcgcagccggtatggtgctcgctgaaacccggcgcggcgctggcttgcaggatatcgtccaaactcaagccgcgcgccagcttggcggcgacgatttcatgctgccgcgccacgctgcggaaagcggacagcagaaacatctccacgccatcctcagccgccgcgcgtcgcatcgccgtccaagcttgcgccgccgcgggcgtgaggtgaaactcgcgcccctcggcattggtttccgccagcgccagctccgccggctcgggatgcgtctccagcccccgcgccagcaagctggcgggatctatccccagttcagccagacgcgccgccagctcggcctgcatcagaacttgaagcccttgtgcagcgccaccacgccgccggtcagattatggtagtcggccttgccgaagccggcgtccagcatcatctgtttcagcgtttcctgatccgggtgcatgcggatggattcggccaggtactggtagctgtcggcgtcgttcgccaccagcttgcccatgatgggcagcgccttgaacgagtagaaatcatagatcggcgacagcggcttccacaccttggagaactccagcacgaacagcttgccgcccggcttcagcacccggcacatttcctgcagcgccgcatccttgtgggtcatgttgcgcaggccgaaggccaccgacaccgcgtcgaagtaattgtcggggaagggcagcttctcggcgtcggccagcgataccggcaggatcacgccttcgtccagcaggcggtcgcggcccacggtcagcatcgagctgttgatgtcggtcagccacacttcgccggtcttgccgacgcgcttggcccagccgcgcgccaaatcgccggtgccgccggcgatgtccagcaccttgtcgccggcgcgcacgccggaggtggtcagcgtgaaatgcttccacacccggtgcaggccgcccgacatcagatcgttcatcacatcgtacttgccagccaccgaatggaagacttcggccactttgccggccttctcgctttcatcgacggtcttgaaaccgaaatgcgtggtcttgtccatgctcactccctgctcgcgccggcggcggcgagcttgtccagatattcctgccagtactggtcgcgcttggcgcccagttcgtatagataagtccagctgtagaggccgctgtcgtggccatcgtcgaaggtgatcttcagcgcgtagtggccgaccggctccagcgccgtgatgccgacctgcctcttgccggtctgcagcgtttcctggccgacgccgtggccgcgcacttccgccgacggcgaatggacgcgcaggtattcgcagggcaattcgaaacgggcgccgtcgtcgaaggcgatttccagcatcttcgacacttggtgcagctggatttccaccggctgggcggcttggggggcgactccggacatggtcttgctttctatgggttctgccgcggcgccaggcgccgcgctttgcatacaaggaaaccttagccctttttctccagcagcatggcgtcgccgtagctgaagaaacggtactccttctccaccgcgtggcggtaagcctggaaaatttcgtcgtagccggcgaaggccgacaccagcatcagcagcgtcgatttcggcaggtggaaattggtcagcaggcggtccaccacgcggaagcggtagcccggcgtgatgaaaatgtcggtctcgccgcggccggcggccagttcgccgccgcgcgccgccgattccagcgcgcgcacgctggtggtgcccaccgccaccacgcggttgccgcgggcgcggacgcgggcgatggcgtccaccgtcgcttgcgggatctcatagatctcgctgtgcatcttgtgctcggccacgttctccaccttcaccggcaagaaggtgccggcgccgacgtgcagcgtgacgaaggcggtttccacgccctgcgcccgcagctgctccaacagcgcgtcggtgaagtgcaggccggcggtcggcgccgccaccgcgccctgttcccgggcgtaaacggtctggtagcgctcgtcgtcgtcgccctcggcgctgcgttctatataaggcggcagcggcaacttgccggaagcctccaggatgtcgaacagcttgtcctcggccaggaagcgcagcttgaacagcgagccctggcgctccagcatttcggcctcccagcggccggcgaagatcagccggctgcccggcttaggcgatttggacgaacgcacgtgcgccagcgcggtgtggtcgtccagcacgcgctcgatcagcgcttctatcttgccgccgctggctttttcgccgaacaggcgggcgcggatcacgcgggtatcgttgaataccaacaggtcgccggcctgcagtttggtcggcagatcggcgaaggtctggtcggacaggttcatgccgtccacgtgcagcaggcggctggcgccgcgcaccgcgggcggatgctgggcaatcaatgcctcaggcaggtgataatcgaagtcggagagctgcatacggaaacaatcaatcagaatcggcaaattatacccgcgcccaccttcccggcacagtgccgcgcatcacatcgccgacgcacacagcttgacccatgccgatattccatttacatattgcaaacatgccacaccgattttccccttaaaatctaatgctttcactctaaaaccagttctcggccgttgtccgcctcgcttaaacagccgttttaaattccgcaaatgctggacattttgcggcgaattgcggcaaactcgcggccaagatgaaaaacaggagtcaggctttgagccgatccatccttgtgctgcacggccctaacctcaatctgctcggggtgcgggaacctcaacactatggccgggacacccttgacgacatcaaccagcgcttggccaaacaggccaaggccgccggtttttccctgtcggcgctgcaaagcaatgccgaacatgtattgatagaacgcatacaccaatgtctggatgacggcaccgccttcatcctgatcaacccggcggcgttcacccacaccagcgtcgcgctgcgagacgcgctggccggggtcaagctgccgttcattgaagtacatctatccaacgttcacgcccgcgaaccgttccgccagcattcctatttttccgacctggcggtcggcgtcatctgcgggctgggcgcccacggttacgagctggcgcttgcgcacgccgtacggcatcttgccgcgcaagcctgaccaccgttacagaacatcccattcgaaggattgacaatggacctgcgtaaactgaaaaaactgatcgacctggtcgaagagtccggcatcgccgaactggaagtgaccgagggcgaggaaaaagtccgcatcacccgcgtatccgccagccaacagcaggtttacgcgcagccgatgccccagatgtacgccgccccggccgccgcggctcccgccgccgccgccgcaaccgatgccgccccggccgcggctcccgccgccgccagcgacaagaacgcgatgaagtcgccgatggtcggcaccttctaccgctcgcctagcccgggctccaagtccttcgtcgaagtgggccagagcgtcaacgccggcgacactctgtgcatcatcgaagcgatgaagctgatgaacgagatcgaagccgaccgctccggcgtggtgaaagccatcctggtggaagacggccagccggtggaatacggcgaaccgctgttcgtcatcgagtaaaaccctcggacgacatcgcgagattcagggcacggccaaggtctgtgcccttgtcgtttgacgtgacagcaacggctccccgggcaagcgtccggctggggccagatcgcggagaaattccatgttcgaaaaaattctgatcgccaaccgtggtgaaatcgcgttgcgcatccagcgcgcctgccgtgaaatgggcatcaagaccgtggtcgtgcactccgaggccgaccgcgaagccaaatacgtgaagctggcagacgaatccgtctgcatcggccccgcgcccagcggcaagagctatctgaacgtgccggcgctgatcgccgcggcggaggtgaccgacgcccaggccatccaccccggctacggcttcctgtcggaaaacgccgacttcgccgagcgcgtcgagcaatcgggcttcgtgttcatcggcccgcgcgcggaaaccatccgcgccatgggcgacaaggtgtcggccaagcacgcgatgattgaagccggcgtgccctgcgtgcccggctccgacggcgcgctgccggacgatccggctgaaatttccaagatcgccaagaagatcggctacccggtgatcatcaaggcctccggcggcggcggcggacgcggcatgcgcgtggtccactccgaaggcgcgctgatcaactcggtgcagatgacccgcaccgaagccggcgccgcgttcggcaaccccaccgtatacatggaaaagttcctgcaggaaccgcgccacatcgaaatccagattctggccgacgaatacggcaacgccatctatctgggcgagcgcgactgctcgatgcagcgccgccaccagaagatcatcgaagaagcgccggccccgggcatcaccgacaagcagcgcgagaagatcggcgaagcttgcgccgaagcctgccgccgcatcggctatcgcggcgccggcactttcgaattcctgttcgaaaacggcgagttctacttcatcgagatgaacacccgcgtgcaggtggagcatccggtaaccgaaatgatcaccggcgtcgacatcgtccaggaacagatccgcatcgccgctggcgaaaaactgcgctataagcaaaaagacatcgttttgcacggccacgcgatggaatgccggatcaatgcagaggacccgttcaccttcgtgccctccccgggcaagatcgagagctaccacccggccggcggccccggcatccgcatcgattcgcacatctaccagggctacaccgtgccctcgcactacgattcgatggtgggcaagctgatcgcctacggcgacacccgcgagcaggcgatggcgcggatgcgcgtggcgctgtcggaaatggcgatttccggcatcaagaccaatatcccgctgcaccaggagctgttcctcgatgcggccttccagcgcggcggcaccagcatccattatctggagcaccgcctgcagcagaaaaaaggggaagcctgatggcctggttgcaagccaccattgattccgactccgccgtcgcggaaaagctggccgacgcgctgatggacgcaggcgccttgtccaccgcgattgaagacgcctgggccggcaccgaccgcgagcagccgatcttcggcgagcccggcgagccggtggaccaattgtggagccagagccgcatcatcaccctgttcgacgaaaacgccgacgtcgcgctgttgatcgccgccgccgccaacgcctgccagctggcgatgcccggctacagcgtggagcgcgtcgaagagcaggactgggtgcgcctgacgcagtcgcagttcgaacccatccgcatctccgaccggctgtggatcaccccgacctggcacgacgcgccggcgcccgacgcggtcaatctgcagctggacccgggcctcgccttcggcaccggcagccaccccaccacgcggctgtgcctgcagtggctggacaagcagctgcaaggcaatgaaagcgtgctcgactacggctgcggctccggcattctggccatcgccgcgctgaagctgggcgcggcctccgccgtcggcatcgacatcgacgcccaggcggttcgctccagcgccgacaacgccgcgcaaaacggcgtcaaggccgatttcttcctgccggacgccaatccgcaagcccagtacgacgtggtgctggcaaacatcctggccaatccgctgcgcatgttgggcgagctgctgtctagccatgtcaaaaccggtggtagaatcgtcctttccggcatcctcgccgaacaggccgacgaactgtccgccatctacagccagtggttcgagatggacgcgccggtgttcgacgaaggatggactcgattgacaggaacccgacgcgccacggtatgacatatacgacacagtgccccaactgccagacccgtttcaaggtcaatgacaaccagctagccgctgccaacggcctggtgcggtgcgggcgctgttcgcatgtgttcaaggcgccggatcatttcgtcgtcacgcagccggctcccgagccggctgtcgcccagccggcgcccgctccggagccggccgccgaacgcgaccccatcgacgacttcgagctggaagtgccggatttcgatccgcaaggcaatcatcccgacatcgacatccccgccgacaatccgctgatcgccccgccgccgtccgcgatgccggcggccgagcctgaacccgaagcggcgccgcaggcggaaatggaagaattccagcgcgcgctggccgaggcgatgcaaaaccgccaggccaccgcgccgataggcaaccccttcgacgatccgcagccgatcgccgccgccgaaccggaagtcttcggccgccgccgccgcgcggaagcgctgccggagccggaaagcaagccggcgcgcgcgcctatcgaagaagagccgctgttcaccgacgccgacgccgaggaagaagcggaagccgccagccaccaacccgccggcccctggctcaacggcgtgctggcggtgctggcggtgatcggcatcctgttcctcgccgcgcagctggtctacatcaaccgcacccgcatcgccgccgaagtgccggaaatgcggccggcgctggaaagcatgtgccgcgcgctggattgccaggtgccctggccgaccgacatcgcgctgatccgcaccgaatggtccgagctcgccttcgtgccggactaccccaacctgatccagttgtcggccacgctgaaaaaccacgcccagtacgcgcaagccttcccgatgctggaggtgacgctgaaggacagcgacgaccaggtgctgatccgcaaagtgttcgcgcccaaggaatatctgaagccggacgatctgaagctgggacgcttcaaccccaacagcgaggcgaagatcaccatgcggctggatgccggcaaggtgcatgcgatgggttacagcctgtactggttctatccctgacagcggcgcctcccggcgccgccaggcctcactcctcctccatccggaatgcgaactcctgcgtcaggctggcgcccggcgtgcagcggtattcgcgcaaggctttattgatctcgtagcgaaagccgctgcggtactgcggcggaatctggcgccaatccgcgctctggatgccggccaccgtgccgtcggcccgggtctggaacatcaccttgaccacgccgcccacctcgtcgcgcaatgccttcaacgggtaatccggcgcctcctgatgcgagcagcccgccgcaacggcgccggccgccattccggcggccaacaggccggccagccatttcgttttccgcatatccatctccttcccataccgtccggcgcaatcgccgcgccggcttccgttatagaactgatatggatattttctattagaacattttcaacaccccgcccctcccgcagtcgcggcgagccggctatcgctgcgcgccgtcatccggcacgaatctcaacttgagttgaaggttggcattgggccggcatcgatattcctccagcatggcgtcgagcgccaaacgaaaatcctcgcggtaagcctcgggaatcgtcgcggaaaacaccatgcttgcccggccgtcgtaacggccgcgggcatcggtgtgaaaaaccagcgtcacgtcgcctgcgatcttgtccatctcggcccgtatcggatacgccggcgccgccatgtgccggcaattcgcctcaagggcgaatgccggcagactcaagcccgccgcggccaccgccaacaagcaaaacctgcgcaccgccgtccttcctttcctgccttgctcgcggccgccgcggcctttcaagcgaagaactccgccagataatcgacaaacacccgcaccttgcccggcacatgccgacgcaccgggtaaaccaccgacaggtccaggcaatgccagttgtagtcctgcaggatggctaccaggctgccctcggccaaagcctgctccaccaggaagcgcggctgcagcacgatgcccatgccgttgatggccgcatcggtcagcacatcgccgttattggccttcagcggccccttcaccctcaccttgtcgcggctgccatccggcgcttggtagtcccatacattgggctgcgacgtcagcgcgtacagcaggcattgatgcgcggccaactccgacggatgcgccggcgcgccgtggcgggcgaggtaggacggcgcagccaccagcagatcgtcgatctgcgccagccggcgcgccaccagcgtggagtcgctgaggttggacacccgcagcgccagatcgaagccctcttccaccaggtccacccgccggtcgttgaggctgagctccacttctatctgcggatggcgctggtggaagccgccgatgatgcggcccaggtagcgcatgccgaaggacaccggcgccgacaccctgagccgccccaccggctcgctggcgccgtgcgacagcagcgcgtccagttcgtccagctccgccagcaggctgcccgcctgcgacagataggtttcgccggcctcggtcagcgacagtttgcgggtggtgcggtgcatcagccgagcgcccaaccggttttccagcgaagccaccagcttggtcaccatcgctcgcgacagctccagcctgtcggcggcggcgacgaagctgcccagctcggccaccgcgacgaaggcgcggatttcagagaagcggtccatattatttcttaaaaatgaacaatgattttcaatttgccgtatttattgaatataaagccgatggtcaaataacgccatacccaatctgacctggagcttttcatgaatcgactgcaaaaccccgcgctcgccgccctgctgctgcgcctgtccctcggcctgatgtatctcgcccacggcgcgctgaagctgttcgtgttcactcccgccggcaccgccgagtacttcgccagcctgggcctgcccggcttcttcggctatgtcgccatcgtgatcgaaatcggcggcggcctgttgctgctggcaggcgtcaaggcgcgctgggtcgcgctgctgttgatcccgcaattgctcggcgccattgcgctggtgcacggcgccaagggctggatgttcaccaacgagggcggcggctgggaatatcccgccttcctgatcgccgcgtcgctggcgctgttcctgctgggcgaaccggcccgcagccaatccgccgcccgataagcaatccatcccccaaggcccgccgtccaggcgggcttttcgcattgccgccgccgttttagagttgccatacaaaaatgcaacaacgccttcccgacccgcattttcgccaagcccgcaagaatcaagcgctatttccatagagccgaaatggatgttgcgccgcagcatgcaatccggacaattctgacttgcacattttcttgattgccatcaagctgctgcgtgatttgtctgtagtttaactacaaagttggcaagatacgcatcagccaggtcgccgcggctgcctggcgaaagcctgtatataattgtcggaatcttgtcagaacaagccagggccccagcagaagctcaaggggccgcatgctggaacaaaactaatcggcttgattgacgctcgtaataaaacgactggaattatccacgaattgaggagtgactcatgggcaccaccgcaccaagactcgacgttctggcccccctttccgggtggctggtccccttggacagcgtcccggacccggtattcgccggcaaaatggtcggcgacggcatctcgctcgaccccacctccggcagcctgctggcgccggtggccggcgtggtcagcaatctgcattccgcccatcacgcgctgaccatcaccaccgccgaaggcgtggaagtgatggtgcacatcggcatcgacaccgtgatgctgaagggcgaaggcttcttcccgctggtcgagcagggccagcaggtcagcgccggccaggccgtgatcgacttcgacatcgaccaggtgggccgccgcgccgccagcctgctgacccagatcatcgtcaccaatggcgacagcgtgcacagcatgcagccggcccggggcatggtgaacgccggccgcgacgtggtgctcagcctgacgctggccaatggccaggccgcggcgcaagtccagagcggcgagccgcagctgtcggccgccatcgccatcggcaacccggccggcctgcacgcccgcccggccgcggtgttcgccagcaaggccaagagtttctcctccgacatccagctgatcctcgccgacaaggaggccaatgccaagtcggtggtggccgtgatgggcctggccaccaagctgggcgacgcggtgcgcatccgcgcgcagggcgccgacgccgccatcgccatcgccgagctgacccaattgctgaacgagcgctgcggcgagaaggccgacgaggcgccggccgccccggccgccgcgccgatcgccatccagcaacaggatagcgagagccagctggccggcgtcggcgcttcgcccggcatcgccatcggccgcatcgtccatcaccgtctgcaggaattcgacgtgcccgagcagggcaagggcggcaatgtcgagcagcaggccttcgcccgcgccgccgaagaggccgcggcccagatcgagctggtcaaggcccagctgtccgacccggccaagcaggccatcctgtccatgcaccaggaactgctgcaggaccccgacctgctggcgctgacctataccggcctggccgaaggcaagtcagccggctgggcctggcgcgccgccttcagcgcctactccgcccgcctggaggcgcaggacaacccgctgctgcgcgaacgcgccaatgacatccgcgacgtcggccgccgcgtgctggcgctgctggccggcgtcaagcaagccgcgctggaattgccggccggctccatcctgatcgccgaggatctggcgccctccgacaccgccgcgctggatccgtccaaggtgatgggcttctgtacccgcaccggcggcgccaccagccacgtcgccatcctggcgcgctcgctgggcattccggcgatctgcggcatctcccaggccgcgctgaaactgccggaaggccgccaggtcattctcaacggcagcgaaggcacgctggccatcgcgcctagcgccgacgacctggccgccgccgagcgcgagatcgcccgcctggccgagcgccgcgccgccgaagccaagggctcgatgcagccggcgcaaacccgcgacggcgcgcgcatcgacgtggtggccaatatccgcaacgccgccgacgcgcgcgaagcggtggccaagggtgccgagggcgtgggactgttgcgttccgaattcctgttcgacaaccgcgacaccgcgccgaccgaggccgaacaggccgccgaatactgcgcggtggccgaggcgctgggcaaggagcgtccgctggtggtgcgcacgctggacgtgggcggcgacaagcccttgtcctacctgccgctgccgaaggaagacaaccccttcttgggcctgcgcggcatccgcgtcagcctggaccgtcccgacctgttgcgcacccagctgcgcgccattctgcaagcggctcctctgacccagctgcacatcatgttcccgatggtggcctcgctggaagagctgcgcgccgccaaggcggtgctggccgaagagcaagccgcgctgggcgtcgccgacgtcaaggtcggcatcatggtggaagtgccttccgccgccgtgctggccgcgcgcttcgcgcccgaggtggacttcttctcgatcggcaccaacgacctgacccagtacgtgctggcgatggaccgcggccatccgcagctggccaagcaggccgacgcgctgcacccggcggtgctgaacatgatagcgatgacctgcgacggcgcgcgcgcccacggcaagtgggtgggcgtctgcggcggcctggcctccgacgaacgcgccgcgccgctattggtgggcatgggcgtcaccgagctgtcggtcagcactccggccgtcgcctcggtgaaagccacgctggcgcgctggagcctggacgagtgccgcgagctggcccgcgccgtgctggcgctgtccaccgtcaccgacgtccgccaccacctgaaccaacacgctcgttaaaagaataagcctcggcgcggcaaagtccgcggcgccggatggggagaccatcggggcgacccggtgccgtccggcgccatgccagcggatttggcgcgcctagggctttatagaggggacggcgtcacagccgctcgacattccataagcatgtcaaagcaggataataatcatgtttagtcaatcattcgcttttctgcagaagataggcaaatcgctgatgctgccggtcgcggtgctgcctgtcgccggcctgctgctcggcatcggcgcgaccgacttccacaccacgaacagcgtcgctctggcgatcctgtccttgatgaagaactccggcgacgtgatcttcggcaacctgccgctgatcttcgctgtcgcggtggcgctcggcttcaccgagaacgatggcgtcgccgccatcgccgcggtgatcggccacctggtcaccaccgtcaccctgggcgtgatggccggcctgatgggcgtgaaaaccgccaccatcatgggcctgccgtcgatccagaccggcgtgttcggcggcatcctggccggcggcatggcggcctatctgttcaaccgcttctaccggatcaatctgcccacctacctgggctttttcgccggcaagcgcttcgtgcccatcatcaccgccatcagcgccatcggcctgggcgcggtgctgtcggtgatctggcgtccgatcggcgaaggcatcgccaccttctcgcactgggccgccgtcagcgacccgcgcaccgccgccaccgtgtacggcttcgtcgagcgcatgctgatccccttcggcctgcaccatatctggaatttgccgttcttctttgaaatgggcgacttcgtcgacgccaccggcaagcacgtgcatggcgacatcaaccgcttcttcgccggcgacagcaccgccggcgtactggccggcgccttcttcttcaagatgttcggcctgcccggcgccgccatcgccatctggcattcggccaagccggaaaaccgcgccaaggtcggcggcatgatgatttccgccgcgctggcgtccttcctcaccggcatcaccgaaccgatcgaattctccttcctgttcgtcgcgccggtgctgtacttcatccacgcctgcctggtggcctcggcccagttcatcgccaacacgctggacatgcacatgggcttcaccttctcgcaaggcggcatcgacttcgtgctgttcaacctgatcggcgacaaggccaagcacgccggctatgtgttcatcctcggcccgatctacttcgtgatctactacggcgtgttccgcttcgtgatcgccaagttcaacctgaaaaccccgggccgcgaagatgaaagcctggaaaccgccggcgccgtcagcgaagaccagcgcgcgcgcgaactggtgctggccttcggcggccgctccaacatccgcacgctggacgcctgcatcacccgtctgcgcatctcggtgcaggacaccgccaaagttgaccaagccaagctcaaagccatgggcgcctccggcgtggtggtggtcggcaacggcatccaggccattttcgggccgctgtcggaaaacctgaaaaccgatatggacatctatctgcgcagcgccggcagcgatgccgagctgtcgtccgccccgcttgcggcccccgcgcctgtcgcggtggctcccgccgcgccggcggctgccgccaaggcagatatcgccgcgctgaagcaggcgctgggtggcaacgccaacctcggcaaggtggaagccatcgcccacacccgcctgcgggtggaactgaaggacgccgcccgcttcgacgaagccgcggcccgctccgccggcgtcatggcggtgatgcaggtcgcgccgggcacgctgcacctgatcgtcggcgatcaggcggccgcgctggccgcagcgctgctagcctgaaaccggtcttagcgccaacaaaaacgccagcttcgcgctggcgttttttttgccgcgccggccggcgcggacgggatcacagcgcgaacaattcgcgcaggtgctgcgccacgccggattcagcgttgctggcgatgcgatgggcgtccggcatttcgctgctgagccgcggatgggcattgcccatcaggcgcggatgcccggcggcgcgcagcagctccacgtcgttctggccgtcgccgaaagccaggcaatgcgccggatcgatatccagccggcccagcaccagccgcagcgcgtggcccttggagacgcccgccgccatcacttccaggcagttctccagcgagaaggtgatgtagagctggtcgccgaagcgccgctgcaacgcctcctccacccgcagcaggtgcgcgtgctcgccaatgtacagcaccttgccgacgccgacgccgtcatgctcggccagattgtctacccggtagctcaagccggaatcgcggtgcatgtcgaggaaggactggcagggctgatcgatcagccactcgtcgtccagatagaaattgaggatggagccggcggcgtattccggctgcgccagcgcccgcaccagctgcggcgcgatgtcctggcggtggatcagcctgccgtccgggtcgtggatgcgggcgccgttggaagtgatcaggtgggcgcgcacgcccagcgcgtcgcggatgcccttcacgtccaggtgatggcggccggtggccagcgcgaattgcaccccgcgggcttccaggctctgcaaggtggcggcggtgagggaattgacggcatggtgctggtccagcagcgtgccgtcgagatctgaagcgatgaaacggtaagacatgcgaactccggtgcggcggaagtgtttgattatacgctgatagcgctaacaatcagactgacggcagcgccgcgagttgcgtaaacgccaatgcggcccattctggcgcggacgttttttgcaagccggcgcccgccgccgcgggcaagctggcaaccgtgccggccctttcgcgccggccaggagcccgccgcatgaacccgctttcccttgccgcccacagcggcgccagcctggacgccttgctgcgccaggccgtgatccagcttggctgccccgaaggacggctggccgacgtggaccagcacgccaccctcgccatccagctgcaagcgctgcccgacgtgatggtgtcggcgctggacgaccgcctgtgggtatggagcattctgcccggcctgtccgaagccaggctgcacgcgatggcggccgagacgctggccatcctgctggagccggtggaagacgtggaaagcggccagctagcgctgggacgcggcgagcacggttatgaattgaaagcgctggtgaggctggactgcctgagccgcgatggcgggctgcagcctgtgctggccgctttcatcgagcggctgcgcgcgctgtgccagacgctgaacctgacgggagaatgacatgccgggcatcaccacgatttcccacgccggcggcgcccagcgcgccgcctcgccctccaccccggccgctccgcgcgccggccagccaaccgggctgacaagcagcccgctccccggcccgacatcgtcgcgccaagcggtgatctacgcgccgttcgccgccggcgacgtggtgacccagagcctgggcaagaacctggtgcgcgagcaaaacggcaaaccactgctgccgctgatcgcgcaggacgaccaggcccatgtccggctgcagcagctgcagcagcagcaggttcaggatctgcgcggcaagggctcgctgtttcccgaccaaatccgcaaattgcagcaacagcacaatctgtcgcaagacgtcctgcgccagcatatcggcccggccgaattcgacaaggcgatgcaggcctctgccaccttcgcccgccaggccgacgtgctgcagcggatggagatccgcagcaacgagcacggcgcggagctgggccggctgcagccgcagcgcgacaagatctacatcgtcggccacggcggcccgggcatggacatcctggcggccgaccagcaggtgacccagggcaaggccacgtccgccgatgtggcgcaacagctggcagccggcggcctggaccgcgccttccgcgatttccgcgccaccgcctgcttcagcgccgacacccgcgagccgacctccttccacccggcagacctgggccgcgccgccgcgccggcgctgggaccgcgcccgggcttcctgcagttgttcggcaaacggccggtgctgagccagcctttcgcccaatcgctgagcgacgagttggccaagcagggcttcaaacagccggaggtcgccggctaccacggcgccggcgtgaccttcagccagatcggccacagctcgcgccgcctgcctggcgccgccgatagccgggcgtcggagctgaagcaggtattcactccgcgcaagtaagccgcgtctgcgtcgtcatgagcgaattctggaagccggctttggtcggctgaataagaattcgctcatttacatgataacgcccgccagtaccgggccaggattccgcaccatgccagacctcgccgccttccaccattgcgccaatgaactgctgcaacacctgggcttcgacgccatcgtgccggccagccatcaggaagtgatcagcctgaccgtggagcagcgcttcgccgtccacctgggcgccatcgaccaagaccattggttcatgcaggccgagctgggcgaacatccgctgcgtgacgccgacccgctgctggcgcaggctttgcgcggcaaccagctgtgcggccagtcctggcagccggtagcggcgctggatgccgaacagcggctgtgttgctggctgcgcctgccgtgccgcggcctcgacctgccgcagctcgccgccgccttcgacgcgctgatcgcccgcgccgaagcgctgctggacagcgccgccgccgcgcgctgaatctccggcgccgggccgctcgcccgcgccgccataagccctttgggcaatccgctaagaaagaagccagatgagcaccatccacaccggcattcacatgatccggcccaacctgtcccagctgaacgaactgggcgccggcctgcgcgccgacagcgcccgcatcggcatccgcaaggacggcagcctggtggtctacaccggccgctcctacctgctgcacccggaccagacccgccgcgcgcagcagttcctgcgccagaaccacttgctggagccgcaagagcgcccgcgcgacatccgcctgctcgacctggtgacgcggctgaacacccgcgccaacagccacacccgtcccagcccgcaggatctggcgcagcggaccgacgccggcgccaagccgcatctgcgctgggctgaccagcagccgccgcgccaggaagccgcctcgctgagccagcgccgcggcctgcagcatctgaaactggcaccgcagcccgccgccgcgccggcaaacccgcaggccgcgctggcgcgcgcgctgggcagcagcgacaaccgcgtcggcctgtccagccagctgcaacagcaagccggcccggccgccagcggcgcggccttcatcaatgacctggccggcgcgcgcttccgcgacatccccaccgccgccgccaccctggtgcgggcgccggacggcgcgcagctgccggccaaccgcgtgcaggtgggcggcgccaatgtcgccatcgccagccaatatccgacggcgggccagctggagagctatttcggcatgctggccgccaaccgcactccggtgctggtggtgctggcctccgaccacgacatcgccaagagccagggcggcggcaatccgctgccgccttacttctcgcaaagcggccaatacggcaaggtggccgtcagcgcgcgcgaaggcagccatagccaactggcgggcggcctggaagtgcgcgcctaccagttggcggtgcaggacggcggcggcaagaaaatctccatcccggtgctgcacgtgcccaactgggctgatttcggcgcccaaggcccggtcgctctgaaagcgttggccgaacacgtcaacgcggtgaaggagaagcagatcggcgtctaccagcgcggcaacagcagcgcgctgaacgacccggacaagctgctgccggtgatccactgccgcgccggcgtcggccgtaccggccagttgatcgccgccaccgagctgctgaagcccggcgcgtccagtctggagtccatcgtcggcgacatgcgccgcagccgcaaccacctgatggtgcagacggcggagcagctgaatacgctggccgacctggcccaacaacagggccgcgccgtcgtcgcctcccagccggccgccgccggcaatcagccgatatacgccaataccgccccgccgctgccgccccgccatccgcgctaagcctgccggcaaacggaaaaagcacgcctgttggcgtgcttttttcatggctgccggcagcctaatgcctatcatccgcaaattgacaaagacataagggacggatagcttgacccattgccccccacatcccgccgccgcgccgcaaggagaatccatgagcaatcgatacggccagttgttccgcacgccgggtgtcgccgagcttgcgctggccggctgggtggcgcgcctgcccggcaccatggtggccgtcggcgtcatcaccatgctgtcgctgagccgtaacagctatagcctcgccggcgcggtcgccgccaccttgacgctggcctccgcgctgctggcgccgcaggtatcgcggctggccgaccgctacggccaaagccgggtgctgccgccggccaccggcatcggcgcttgcgcgctgctggcgctgattctgtgcaaccatctgcacgcgccggcgtggacgctgtacctgtgcgcggcgccggctgcctgcctgcccagcatcccggcgatgacccgcgcgcgctgggcgcgactgctggaaggccagccgctgctgccgacagcgttcgcgctggacagcgtcttgagcgaaaccgccttcgtcatgggtccgccgttgtcgataggcctgtgcatggcctggtttcccgaagccggcccgctgttggccgcgctgctgatcctgttcagtgtttccgcgctgctacgccagaaagccaccgagccgccgccccatcccatcacgtcggacagccgccgtccggcgctcttcctgcggccggtgccggttctggccttgctgatgggcacgctgggcgccatcgcgggcaccatagacgtcgcctcggtggccttcgccaaggcgcagggccagcccgccgcagccggctgggtgctggcgctgtacgcgctgggctccggcataggcggactggccttcggcgcgctcaagccggctctgccgctgggtaggctgctgctgggctgctgcctggccaccgcggccagttccaccctgatcgcgctggcgccgaatgtgatatggctggcggcggtgatgctgttgtcgggattgtccttcgcgccgacgctgatcgtcgcgatggaaatggtggaaaaggccgtgccgcgcgcgcgtctgaccgaaagcctgacctggctggtcaccggcatccagttgggcgtcgccggcggcgcctcgctgtgcggcctggcgaccgacgcctacggcgcccgggccggcctgagcctggcgctggcggctggcctcgcctcgctatcgatcgccgccttgcaaccgcgcgtagtacccacgaaaagcgcttgctgaaagccctgcctgaagcaatgttaaaggccgaacccgcatgagttgtggctttttgactctggcaaatccatcctgtctgtatatagaatttcacactgagaaattttaatgctctcacaagcctgcacaagcatagtttgcagcccacgaggcgcatacggctccgtcctcgcttacacattgcatcgatacgtccaatcgctcacgaatatccatactcacgaccgacacgtggaccactcgatatcacctcggatctgccccgcaatccgatgcgacaatacgatacaattttcatgaaactcctaaaccgcgggatttcatccactccgcggactactccagtagcgtgtagcccataaccgtgaattcgcacatcagactagcctatccatgctagtcaaaacatagaagaaagcgatattgacatgcaaacccgtttattagccagtcttctgactctaaccttattgagcgcatgcacaagcacacagctcgctggcgatcctttaaatgaaaaaccagatagccaatctggaactgtcatcttatcgctcaccatcaatactggtgaagtaccgcccattgagcttattgaactgaccagaaatgaggatcccacatcaggatttaataaaaaatatcagctcaagaatatcgttccaggcctctcaaaagatactgcactttatattggcacccttccagctggaacctataaacttgactacttgcgtgctcaattgaaatttttgtcagtatctccaggacagcgagagctagttggagattttcgcgttgaaccagggaaaacctcagatcttggtcgacttattctgacagcgatcaactacaaagtagcctttggacgcagtcttcatgaaaaagacaaccgaaaattagtagcgcttgcggcgccgtcataccaaagtctctatcaacaagcctcatcaacaggctggctgaaaaccgagccaacagaccgcattgaggcatacgcgctcagcagaccgcaaggggctggcggctttagcgaattagctgatcataggataataggtgggtcaaggtttggcagcatattggtacgccaagattctggccactggaaactgattggaagaactggtgaactcaattccattctattcaccactccctatcccatccagccctatatggcggttgccgtcggtgagttcggtagttttttcaaagtgcgcatggatggcaaaaccttgcctatcgaccgaggaaatcttcctcttggaaattatttcttcatagacagttctccagatcaaaaacactggtttgtcggagtccagctgcctggaaaagtatccttgtatgaatccaatcaattggaaaatggaaactggaaaattgcaagagaaaatccggcaggaatattatggctatggcactatcctggcggtattggttatgcatcaagctcggtccgagtgattgcctgctatgactatgcgcaaaagcaatggcgccaaaatgatactcctgaaaagcgttatatcatctcagtggccggtggaccgacaaagtcggtcggcgtgctaactcaggtaggcttaggaattgcgggagtattcgccaaaacccattacagctcagattgcggagccaactggaaagaaactcactccccctataccgtcaaagcttccgctcccatcattctgccatcaggccagattttggaaagcggtggcgtattcggcgataccggcatttaccgcagtgacgatggtagcaactggagcaagatttacagcgatcagctgatattgcgcgatcacatctgggtcatgccgacggcaggcctgatcagcgtatcgaatagcattaacggagttgaggacatccaatattcgaatgatggaggagctacctggagtactgaagtcacgagctacgactcaaggcaaaataacacaaaggactgaccgttaagcagcgccaagcggaccgtttcggtccgcctcgaattaagccgatcccaaatggaaaacgcccagcaattgcttgctgggcgtcgtaatctggtggccagtcgcggaatcgaaccacggacacgcggattttcaatccgctgctctaccaactgagctaactggcctaagttgtggtggccagtcgcggaatcgaaccacggacacgcggattttcaatccgctgctctaccaactgagctaactggccacatctgtctgcccgcgctgtcgcgccgtcagagccatgcatttaatcagaggacggcttttgagtcaaggcataattgcaaaaaaacggctcgccctccgcctgaaaacacaaacagcccggccgctcaacgcgcccgggctgccggatcaaacacttacaccgcgtccggctgcttggcaggatgcgcgtcggcaaatgccggcagcgcctccaacgcctccgcaatgcggacgatggtcggatacggcgccaggtccacgccgaagcggcgcgcgctgaatacctgcggcagcaggcacacgtcagccagcgtcggcgcgtcgcctaccgcataacggccggcagtctgcgccagctgccgctccagcgcgtcgaagccggtgcggatccagtggcggatccactcggtcttgccctcttcgctcgcgccgtgctcggcctgcaggaacttgcccaccctagggttctgcaaggggtggatgtccgccgcgatggccagcgcgatcgaacggacccgcgcccgcgccgccggctcggccggcagcagccgcgccgtgtccggataggcttcgtccaggtattcgcagatcgccaaggactgcgcgatctgcacgccgccatcgtccagcagcggcaccaggccgtacgggttgatcgccagatagtcggcgctgcgctgctcgcccttgagcaggttcaccgcccgatactggtaagccagtcccttcaggttcagcgcgatgcggacgcggtatgcggcgctggagcggaagtagccgtacaggacgcgttcagccatgggcgaccacggtttgctcgatggcgccgaagatgctgtcgccggccgcgctcttcatctcgatgcgcaccgtgtcgcccaccttcatgaacggcgtcttcgccgcgccctgctcgatggtttctatcatccgctgttcggccaggcagcaggagccgacgctgcggtccttgttggagatggtgccggagccgacgatggaaccggcgaccagctcgcgggtcttggagacgtgcgccaccagctgcgggaagctgaactgcatctccacgccgcaatcgggcttgccgtagaacgcgccgttgtagtcgaccaacagcggcagatgcaccttgccgccctgccaggcgtcgcccagctcgtccggcgtgacggcgaccggtgaaaaggcggtggccggcttgctctggaagaagccgaatcccttggccagctcaggcgggatcagattgcgcagcgtcacgtcgttgaccagcatcagcaagcggatgtgcttctcatcggctggcgcgcccagcggcacgtcgccggtgaccaccgctacctcgccctcgaaatccaggccccaggcctcgtcgcgcagcgggatgccggccgtcggggcgaggaaggcgtcggagccgccctggtacatcaaggggtcggtgtagaagctttccggcacctcggcgccgcgcgccttgcgcaccagctcgacgtggttcaggtaggcgctgccgtcggcccactggtaggcgcgcggcagcgggctgaggcagcgcccggagtcgaaggcgacctcgtccggcaccttgccctggttcagggcggcgtagacttcctgcaggcgcggcgcggcctgcgcccagttgtccagcgcgccctgcagcgtggcggcgatggcggaaacggccaccgcgcgggtcagatcgcggctgaccaccatcagctgtccgtcgcgggtgtggttgtgataagtggctaatttcatcttgatgttctttctgctagcggccgctgcgggccgttcctctatatccattttccggcttggcctgagcgcgcttgcgccgcgagcgggcctcggtcggcgggagaagctcagcggtagccatcgtaccgcaagcctctcggcgccaaggtcgggccgctctgcggcgctggcctcaaaccggcttgggcttccagctgtccacgtatccttgccactcgacgctggccaggcccggcccctgctccagggcgtcgcgggcgtctatcatcaccgccacttcgtcggtgaatttcttcggctcggtcatcgccttggcgaaggccttcgggtgcgggccatgggtgaagccggccgggtggaaggtcagcatgccaggtttgatgttgtcgcggctgaaaaagtcgccggcgtggtagaagatcacttcatcgtaatcgtcgttgttgtgatagaacggcactttcagcgcgcccgggtcggactcgatcggccgcggcacgaaggtgcagatcacgaagccgtcggcgacgaaggtggtgtgggccgacggcggcagatggtagcggtggctcatcagcgggcggatgtcgcgccagttgacgcgcgccaccgaattgttgccgtgccagccgatggcatccagcggattgaacggataggtgacgatggacagcgcgccgcggcgcttgatcaccacctgccattcgtcctccgtctgctgcgccttgaagacatcatcgatcgccggcacgtccagcaccgcctcgtcgaagatcgcgtgcggaccgaccaggcctttttccggcagctggtaagcgccgttgctggtctcgaccagcagcatggtggtcgggctggccggctcgatgcgccagctggtggagcgcggcaccaggatgtagtcgccgtcgcggtagctcaagtggccgtaatcgcaaaacaattcgccgctgccggcgtggatgaacaagaggtcgtcgccgtcggcattgcggaacagctgggtcatcgcctgctcgcagcgccagatgcgcagcttgcactgggcgttgtgcaacaccagcggcgcgtcccacggcgccggcgcgccgtgcggcagctcgttcaggtcaaaggcgcgcgggcgcaacgggccctcccacgcgctccaggccgtgggcgggtgcttgtggtgcagatgggtggccgggccgaagaagccgctgcggccgacttcccgctcgtaaatggcctcggccggaaaatcggcgtgggcctggcgcgagaacgtgccttcgcggtgggggtaactgatccatttacgcatgtttgatgtcctgtccgtccggccatgccgcgttggccggcgcattgcaagggataagcggcgcgacgccgcgcgcccgtcggggaggctcccggacgggctggcgcggcaaagcgtaggatcaatcggccttcagcacgccgcggcggatctgatcttcctcgatggactcgaacagagccttgaagttgccttcgccgaagccctcgttgcccttgcgctggatgatctcgaagaagatcggcccgatcacggtttcggtgaagatctgcagcaggatgccttccaccggcgcgccgtcgatcaggatgctgttcttcttcaggcgggccacgtcctcgccgtggttcggcacgcgggtgtccaccttttcgtaataggtgtccggcgtatcgaggaagcgggtgccgcgcgccttcagcgtttccaccgtggcgtagatgtcgtcggtggtcagcgcgatgtgctggatgccttcgccgttgtactggcgcaggaattcctcgatctggctcttgtcgtcggacgactcgttgatcgggatgcggatcttgccgcaggggctggtcatcgccttggacaccaggccggtcagcttgccttcgatgtcgaagtagcggatttcgcggaagttggcgatgccagtgtagaagtcggcccaggtggccatattgccgcgcgccacattgtgggtcaggtggtcgatcagggtcaggccgacgccgaacgggtgctggtccacgccttccagcggcacgaagtcgatctcgtagatgtccttgccctggccgtaacgatcgacgaagtacaaggcggaaccgccgatgccctgcaccgccgggatattcaactccatcgcgccgaccgggcgctgatacggcttggcgccgtgcgacagcgcgtattcatacgccttggcggcgtccttgacgcgccaggccatcgcacaagcggacgggccgtgcgccttggcgaactcgctggccggctggctgcgctcggcgttcaggatgaagttgatgtcgccctggcgatacaggcgcacgtccttgctgcggtggcgggcaacctcggtgaagcccagcgacaggaacagctggttcagcttctccacgccctcggcgtcgggggcggtgtattcgacgaactcaaaaccgtcggtggctagcggattttgcagcatggcttccattttcatcagtttctcctctgttatagtctggcgaaagaattttcttgcgcagacaatcgactcggcatgagcgctacttgtaaacgtctgcaggcggaccgcgttatgtaagcaggccgccttccctcccgcgcggcgggaggatggcagtttcgacagggcgggacgaggcagggagaggaaagccgcggctcgcgcaggaacacgcgaactggcgccggacgccgatgacggcacggcaaactctcctccgaacgaatcgttatctgctgtcacacaccatcgacacgcatcggcagtctgatgctgccgtttgcttgatttaggctttttattctatggaaagcccgcagcaattatcttgctaaatggcttaacttaagcaatattgaagaataaaatgtctcaactaaccgataatcaggagaaaatatgccaagtctcacattagacaagacagacttgcgtattctggccgagctgcagcttgacggccggttgaccaacgtcgagctggccgagcgcgtggccctgtcgccatcgccctgcctgcgccggctgaagcaactggaagagtcgggcgtgatccgccaatatgtcgccctgctggatcctgcgcatatcggtttgggcctgcaggcctgggtgcgcgtgacgctggaaaaacgcggcaatctgcatctgcaaagcttcatcgaggcggtgcagagctggccggaagtgatcaactgcttcgcgatgaccggcgagatggactatctgctgcaggtgtatttcgaagacatggagcatttctcgcgcttcgtgatggacgaactgctgcagcacccgggcgtggaagacgtgaagtccagcttcgtgctgaaggagatcaagcgcaccaccgcgctgccgctgggacagctgcgcagcatgtaagcgctggcggaagacggaaaaaatggcccgagagggccatttttcatggagaagcgcgccgcctcaatgcccctgatgatgggcggcggtgctggacagcagcttgtcggtataggcgatggccgccgccgacagcaggaaggccaggtgcaggaacagctgccatttgatggtgtgctcgtcgatgcggctggcgttgatgaaggtttgcagcaggtggatcgacgagatgctgatgatggccatcgacagcttcaccttcagcaccgacgcattgacatgatccagccactccggctggtccgggtgggtgtcgatgcgcagccgcgacacgaaagtctcgtagccgcccaccgtcaccatcaccagcaagttggcgatcatcaccacgtcgatcaggccgagcaccgccagcatgatgtcggtctcggtcaggtggtccagcccctccagcagctcccacagctgggcgaggaatttccacgcgtacacgccctgcaccacgatcaggcccagatagatgggcagctgcagccagcggctgctgaagatgacctggcccagcagcgacttcctgggctcccggcgattcgttatgttttcttgcatgaggcttcctgatgttgcaagccggaggcgctcccgcgggaacgcctccggccgtcacaggcccagcctctgccagatggtggagaccaggcccgcctggttcaaagtgtaaaaatgcagaccgggcgcgccgccctgcaacaggcggtcgcacagctcggtcaccacatccagccccagcgcgcggatggaagcggtgtcgtcataataggcctgcatccgctgccgcagccaacgcggcacttccgcgccgcacatgtcggaaaatctgcacagctggccgaaattggagatcggcatgataccgggcaccaccggaatgtccaccccgcgcgcctggatctcgtcgacgaagcggaaataggcgtctgcgttgaaaaaatactgggtcatcgccgagttggcgccggcccgcaccttgcgcacgaagttgttgatgtcgtcttcggccgagcgcgcctgcgggtggaattcgggataggccgccacctcgatgtggaagtgctcgccgtgctgctcgcggatgaaggacaccagctcgttggcgtagcggaattcgccggccgccaccatgccggacgggatgtcgccgcgcagcgccaccaagtggcggatgccgttgttgcggtattcgtcgaggatcgccgcgatgttctcgcgggtcgagccgatgcaggacaggtgcggcgccgccgcgtgcccctcgctgcggatctccagcacggtggacaaggtgccgtcgcgggtagttccgccggcgccgaaagtcaccgagaaaaactgcggcttgaactgggccagctgctggcgcgtggtgcgcagcttggcgatgccttccggcgtcttgggcgggaaaaactcgaaactgaaggtgcgtggcgtctgcgtcatcatgatcctctctatcgctgtcctggctatcttgtcgtcgccggcctctttgtgccgttgcgcgtttgccgctgcccgaaaaaaacggacagctccattctatgggggctgtccgtttcgccttggttcaataatcaataacgatagtgatccggcttataagggccttgcttgggcacgctgatgtaggccgactgctgatcggacagctcggtcagccgcgcgccgatgcgggccaggtgcaggcgcgccaccttctcgtccagatgcttgggcagcacatacactttcttgtcgtacttctggccgttggcgaacagttcgatctgcgccagcacctggttggtgaagctgttggacatcacgaagctcgggtggccggtggcgcaacccaggttcaccaggcggccttcggccagcaggatcacgcgcttgccgtcggggaagatgatgtggtcgacctgcggcttgatgttctcccactggtactggcgcagggaggcgacttcgatctcgctgtcgaagtggccgatattgcagatgatggcgttgttgcgcatcttcttcatgtgctcgtgggaaatcacgccgacgttgccggtggcggtgacgaagatgtcggcttcgccggccacctcgtccatccgcaccacgcggtagccttccatcgccgcctgcagcgcgcagatcgggtcgatctcggtcacccacaccgtggcgcccaggccgcgcaagctttgcgcgcagcccttgcccacatcgccatagcccagcaccaccgccaccttgccggcgatcatcacgtcggtggcgcgcttgatgccgtcgaccagcgattcccggcagccatacagattgtcgaacttggacttggtgaccgaatcgttgacgttgatcgccgggaacggcaggtggccgtccttttccagctggtacagacggtgcacgccggtggtggtttcctcggtcacgccctggatgtgctgcaggcgcttcgaataccagtacggatcgatggccaggtggcgcttgatcgacgcgaacagcgcggtctcttcctcattggtggcatgggcgatcgcgccgatgtccttttccgccttgctgcccagcatcagcagcaaggtggcgtcgccgccgtcgtcgaggatcatgttggccggctggccctcgggccattcgaagatcttgtggctgaattcccagtactcgtccaggctctcgcccttgaaggcgaataccggaatgccggcggcggcgatcgcggcggcggcgtggtcctgggtggagaagatattgcacgacgcccagcgcacttcggcgcccagcgcggtcagggtttcgatcagcaccgcggtctgcaccgtcatgtgcaggctgccggcgatgcgggcgccgcgcagcggctggctggcgcggaattcgtcgcgggtcgccatcagaccgggcatttcggtctcggcgatgttcagttccttgcggccccagccggcaaggttgatgtcagctacgtgaaaatcggaaaaatcagccatcgtgagccatccttgttcacgcggcaggaggaatggggctcacccgccattccgtgccagccacggtcatgagtcaggtgagcgccgttgtgtcgcagactttgcgtctccacgcttcccgagcctggggatgcggttgctgaaccgctcctcgcagcgctcctcgggatgccgagtaattatacctagtcaggcgagaaaggataggacaagtcatgtcaaggcgataaactggcggtctttccatcccgccgccgcccatgcccttcgtgttcacaccgctggccgcgctgtccggcctcgccgcgctgttgtccgccgccatcagcgtcatcgcctggaaccgcaggcagttcgccggcgtgcgctggctggccttgctgatggcctcggtggcgttctgggccgccggcgcgatgtgcgaactgtcggccaccagcctgtccgccaaagtgctgtggtccaaggtggaatatctgggcaccctctccaccccggtgctgttcctgctgctggcgctcgactacaaccacatcgacctgatgcgccgccgccgctggctgccggtgctgttcgcgattcccgcgctatgcctgctgctggccgccagcaacgaataccaccagctggtctggaccagctaccgccccagcccgtccggctacaatttgctgatctacggccacggaccggcgttctggctgggcgtggccggctattcctacctgatgatgctgctgggcagcctgctgctgatccgctcgctgcattactacccgccgcatttccgcggccagtccatcacgctgatgctcagcgcgctggcgccctggctgggcaacatcctctacctgagcggcctgttccccctgcaggggctggatccaaccccgcactccttcgccttcaccggcatcgtcttcgcgatcgacctgctctacctgcgccagctctatctggtgccggtggcgcgcgcccgcgccttcgaggcgatgggcgacggcatcgtggtggtggatcagcagctgcgcattctcgacatcaatccttccggcgcgcggatgctgggccagccggccggacagctgcaaggcagcgcgctgcccgcgccctggctggacagcgccaggctgcggcgcgaaggccagttgctggagatgatggcgccggccagcggcaagattctggacatccgcgcctacgccatcgaccaaggccggcatcccggccacaccctgatgctggtgatgcgcgacatcacccagcgccgcgaggcggaggacgcgctgaaaaacgccaaccagcaactggtggaacggctggcgcagatcgaacagctgcaggcggcgctgcgcgaacaggcgctgcgcgatccgctgaccggcctgtacaaccgccgctacctggacgaaaccttcgagcgcgaaagccggcgcgccgaacgcgaaagccagccgatcgcgatggcgatactcgatctggacaacttcaagcagatcaacgacagccatggccaccaggtcggcgaccgggtgctgcaagcgctggcccgcctgctgcagcgcgaatgccgcgccaccgacatcgtctgccggctgggcggcgaggagttcctggtattgctgcccggcagcgacgccgaacaggcccaggcgagggtggagggctggcgcggcggcttcgcccggcttagccatgccggccgcgatcatccattccaggccagcttctcctgcggcatcgccgcgctgccgcgccatggccgcgcgctgtccgaactttaccatcatgccgaccgcgccttgtaccaggccaaggccgccggcaagaactgcagcgtgcgcgcccccgcctgagccgcgcccatgaaaaaaccgccggtcgaaaccggcggtttttctggcgatgcccgagtccttacagaccggcgtcggcgcgcagcgcctccaccttgtcggtgcgctcccagctgaattccggctcttcgcggccgaagtggccgtaagccgcggtcttgccgtagatcggacgcagcaggtccagcatctggatgatgcctttcggccgcaggtcgaaatgcttcttcaccaattcgacgatcttttcgttcggcaccttgttggtgccgaaggtgtcgaccgcgatcgaagtcggctcggccacgccgatggcgtaggagatctggatctggcactggcgcgccaggccggcggcgacgatgttcttcgccacgtagcggccggcatacgccgccgaacggtcaaccttggacggatccttgcccgagaacgcgccgccgccgtgcggcgccgcgccgccgtaggtgtcgacgatgatcttgcggccggtcaggccgcaatcgcccatcgggccgccgatgacgaagcggccggtcgggttgatcaggaatttggtttccggggtgatcatctccggcggcagcaccggcttgatgatgtcctcgatcaccgcgtcggtcagcgtcttgtggtcgatgtccgggctgtgctgagtggacagcaccacggtgtcaatgcgcttgggcaggccggtggcggcatcgtacacgcaggtgatctggctcttggcgtccgggcgcagccacggcaggcggccgtccttgcgcagttcggcctggcgctgcaccaggcggtgcgcgtagtagatcgggaacggcatcagcgtcggagtttcgtcgcaagcgtagccgaacatcaggccctggtcgccggcgccctggttcaggtcgatgccctcgccctcgttgaccccctgggcgatgtccggagactgcttgtcgtagcaggccatcaccgcgcagccgcggaaatcgaagcccagttcggagtcgtcgtagccgatgcgcttgatggtttcgcgtgccaccttgatgtagtcgacattggcggtggtggtgatttcgccggccagcaccaccaggccggtattgaccagggtctcggccgctacgcgcgcgtgcttgtcctcgcgcaggatcgcgtcgaggatggcgtcggagatctggtcggcgaccttgtcggggtggccttcggatacggattccgaggtaaacaggtattcactcatttattctgcgttcccaaaaaaatacaaaaccttgtgatgataaaataggccgctttgagaccaagactgcgcttccatatgtcaaagctagtccatttactgctgtctttcctggcgcacctacccctctcctggctacaaggtttgggtgccgttctcggacgattgacttatcatgcatccccccgcttcgcgatgcggctgcgggagaatcttagttctagtaaaatcttcgaaaactatcaggttttaccacgcgaagtcaaacgcagcgcggcggaaaccggcaagggcgcgctggagctggccatcgcctggtgccgcagtccggaagacatcgccgcgatggtcaaaagctgcgacggttggcatcacgtggagtcggcgctggctcaaggcaatggcattatattcgtaactccgcatttgggcagctacgatatcgccggacgttatataagttcgcgtctgcccttcccgctgaccgcgatgtaccgcccgcccaagctcgcctggctggagccggtgatgcaagccggccgctcgcgcggcaagggcaagaccgcgccggccaccgccgccggcgtgcgggtgctgatgaaggcgctgaaatccggcgaagccaccatcatcctgcccgaccaggcccccggcaacggcgaaggcgcttgggcgcccttcttcggccggccggcctacaccatgacgctggtgccgcggctggcgcagatgagcggcgtggccacgctgttcttcgtcggcgagcgcttgccgcgcggccagggcttcgccgtccacatcgaaccgctggcccagccgttcaccggcgacaaggaagcggattgtgccttgatgaacgcccaggtggaaaacctgatccgccgcttccccagccagtacctgtggagctacaaccgttataaatgcccggccggcgtcacccggccggacgatgcacaaggacacgcatgagactcgctttcgccctgttgtggctgatccgcctgttgccgatgcgggccatcggcctgatcgccgccggcctgggcaatatcgcctacttgctggccggcggccgccgccgcgtcggcctgatcaacctccggctttgcttccccgacatgccgctggccgagcgcaggcggctggtgcgcaagaactgccagcacatgatgcggctggtgctggaatacggcgtctgctggtggagttcggccaagcgcatcgacaacctggtcgacatcaagaacctgcattacgtcaccgaactgcgcgacaagggcgaggacgtgatcctgttctatccgcatttcgtcggcttcgagatgtgcgtatacgcgctgaaccaatacatcccgctggtcagcgtctattcgcaccagaaaaacgacacgctggaccgccagatctacgccggccgccagcgctacgacaacgcctacatcgtgtcgcgccaggaaggcctgcgcccgatcatcaaggcgatgcgcaaggaccacgcgcccttcctgtatctgccggaccaggacttcggcgtgcgcgactcgctgttcgtcgacttctttggcgtcaaggccgccaccatcaccggcatgtcgcgcatcgccaagctggcccgcgccaaagtggtgcccgccatcgcccgccgcgtcggcgaccgcttcgagctggagttctatccgccctgggacaactacccgagcgaagacatcgaagccgatacccgccgcatgaacgccttcctcgaagagcgcgtgcgcgaaatccccgaccagtatttctggctgcacaagcgcttcaagaaccgcccgcaaggcgagccgcgcttctactgagcgccgcccgccagccgcaggccgtcccgcccgatgccggacggcctatttgccatcagcccctcctcggctaccaagcaggcaacaggaaaggctccttgcaggtatcctcgtactcgccgtccggcgtattcacaaaagcctcggccttcgggaagtccgccagcctgtccgccttcaacgtgaaccaggcctgggtcagcacattgcggccttgcttgtccttgccgcactgcagctgcagcgagcgcgcctgatcggtgccgaaggccttgacgaaagcctcttccaactcctcgcgccgccgcacctggccggcctgcgccaagagataggcgccgaagccgctgtctgccaccgcctggcgcatgtccatcgccgtcgagaagaagtcgacgccgttgtagccgaaacactgcacgtgcttgacgtattcgtgggtgtacaaatcatccttcagctgcggcatcacctggctcaaacgctgccgcagctcggtcggcggcagcgcgatggccagcgcgtgcgggaagaaagcgcagcccttggcccaccactgctgcaccggcacgccctgctggatgaggctttgcggcagcgacggccacaagccgtgcaggccgatcagcggctgcttgggctgctccggcagacagccgtcgccggtggcgcaaaagccgggctgccaggtcagcgcgaaggtgtaatgggcgaaatcgccgtgccgggcgggctgcagcggcttggcctgcgccgcgccggccaacagcagcgcggcaagggaagacaataggaatttgagcatgggatctgtggatgaagttggcccgcatcgcgtgcgggcggcgcgcacaaggcatgccaatgtcaaccatatccggccgccacgcaagccgcggcaacacatctaaataaaaaaagcactgccgaggcagtgcttttttgtgggggcgaacggatctactggcctggcttgcgccagaagtagcggtagacgaagcccggaaaggccgccaccaggaacagcgagaaggtggtgacgtaaaactgccagttctgctcgtgcaccggcatctgccgcgactccagcagcctggccaggccgcccatcagcaagaacagcgccgccagctccagcgcctgccagccgaaatgcttgcgcgccaccttgacgaagccggccacacgggtggtgatgaacggcaggttggcggccgcgaaggccagcaggagcagaatggtgatgctgctttgcatgggtcttgtcctgtcagatcacggtcagcgattggcgcatcgcttgcaggcacagctccagcagcgattccggcagcacgcccaccgccagcagcgccagcgcgttcagcgacagcaccagcttcatgtcggcgcgcacggcgatcgggctgttgtcagccgcatcgtcgaagtagatggccttcaccacgcgcaggtagtagaacgcgccgatcaccgacatcaataccgagaacaccgccagcttgaccatgccgatgtccaggatggccttgatcaccacgaacttggcgtagaagccggccagcggcgggatgcccgccatcgagaacatcgccagcagcatcaacagcgcgtaccagctgttgcggctgttcaggcccttcaggtcgtcgatcttctcgcactcgaagcccttgcgcgacagcgccagcatgatgccgaagccgaccatcgacatggccacatacaccaccgcgtagaacagcgcggcggagtagccctgctgggtgccggacagcacgcccagcagcaggaagcccatgtgcgagatggtggagtaggccagcatccgcttgatattggtctgcacgatggcggtgatgttgccgatggccatcgacagcacggccacgatcaccagcatgccctgccagtcgccgaccagcacgtccaggccttgggccaggatgcgcagcacgaacacgaaggcggccagcttgggcgccgcgccgaccatcagcgtgacggaagtcggcgagccctggtagacgtcaggcacccacatgtggaacggcaccgcgcccagcttgaagctgaggcccgccacgatgaacaccaggccgaagagcagcagcatcgggttggcggcgtgcaacttgatggacttggccacgccggccaactccagcgtgccggtggcgccgtagatcatcgagatgccgtacagcagcaggccggaagccagcgcgcccagcacgaagtacttcatcgccgactcggtggcggccaccgaatcgcgttgcagcgcgatcagcgagtacagcgccagcgacagcagctccaggcccatgtacaggctgaggaagtgcgaagccgacaccatcaggttcatgcccagcagcgcgaacaacgccagcgagaagtattcgcccttgtacaggccgcggtcggcggtgtactggcggctgtagaccagcaccaccgcggtggcgccgtacatcgccagcttgaccagcgccgccagcggatcggcgacgtacatgccggagaaggtggtcaccgggtacggcgtaaaggtgtagacctgcgcgacggcggtgccggctagggtcagcagcgtcaggccgtaggtgatgcagcgcttttcatcggggatgaaaagatccagcatcagcaccaccagcagcgcgccgatcaggaacagctccggcaaggcgggtatcaggttgagatcagcccaattcattgtgtttattccttccgtccttacggcagcttggtctgcgcaacatgcgcgatcaggtcattcaccgcgaggtgcatcttggaaacgaaggcctgcggatacaggcccatgcccagcaccatcagcgccaggatggccagcaccaggaactcgcgcttgttgacgtcggacagttcggccacgtggctgttggccacatcgccgaagatcacgcgcttgtacatccacagggtgtaggcggcgccgaagatcagcgtggtggcggcggcgaaggcgaaccagaaattcacctgcacggcgcccatgatcaccatgaactcgccgacgaagccggaagtagccggcaggccggagttggccatcgcgaacagcatcatgaaggcggcgaagatcggcatcttgttggcgacgccgccgtagtcggcgatgttgcggctgtgcacgcggtcgtacatcacgccgatgcagaagaacatcgcggcggagacgaagccgtgcgacaccatctgcaccagcgcgccttccaccgcccactggttcatctccgaaccggtgaacatgaacaggcccagggtgacgaagcccatgtgggagatggacgaataagccaccagcttcttcatgtccgactgcaccagcgccaccaggccgatgtagaccaccgccaccagcgacaggccgacgatgaccggggccagttcgcgcgaggcgtcaggcaggatgggcagcgcgaaccgcaggaagccgtaagcgccgatcttcagcgtgatcgcggccagcaccatcgagccgccggtcggcgcttcgacgtgggcgtccggcagccaggtgtgcaccggccacatcggcaccttcaccgcgaacgacaggaagaacgcgccgaacagcagcagctgcgcggtcagcgggatcttggcgatctgatggaaagcctggatgtcgaagctcttgccggccaggaagtacaggtagatcagcgccaccagcatcagcagcgagcccagcagcgtgtacaggaagaacttgatcgacgcgtacacgcggcgcggaccgccccagacgccgatgatcaggtacatcgggatcagcatgccttcgaagaagacatagaacaggatcgcgtccagcgcggcgaaggcgccgttgatcaggcccgacatgatcaggaaggcggccatgtactgcgcgacgcgcttctggatcacttcccagcccgcgatcaccaccaacaaggtggtgaagctgttgagcaccacgaacagcatcgagatgccgtccacgcccaggcggtagttgatgcccagcgaggcgatccacggcttgctttcgacaaactgcatgccgccgttgaggttgttgaattcggtgaacagcggcaccgacagcaggaagcccgccagggcgcccgccaccgccagccagcgcgccagcggcgcgcgctggtcgccgccagtggccagcactaccaagccggccagtatcggcgtccagatcaccagacttaacagatttgtgaacataatcaaacctatattgttatttcaatcgcgagggccagcgctcaacgccagatcagctgccagaacgatatcgtcatcagcgccagcaccccgatgatcatcgcggtggcgtagctgtagatgaaaccggtctgcaggcggcggatcacggcggagaagcaaccaaccagcttggccgtgccgttcaccagcaggccgtcgatcagcagcatgtcgccgatcttccagaagaaggtgcccagcgcgcgcgagcctttggcgaacacggcgaagtagatctcgtccaggtagtacttgttttccagcagcttgtggatcggcgcgcacttttccttgatggcggccgggatgtgcggcgccttcatgtagaagtaccaggcaaccacgacgccggcgatggccagccacagcggcaaggtggtgaacgagtgcagcgccatggcgacggcgccgtggaactcgtggtgcagctcttccatgcccgggtgcagcgcttcgttgacgctgatcgctttgccgaagaagctgccgtaaaccaacttgtcgatgccgaagaagcctaccagcaccgacgggatggccagcagcaccagcggcagggtcacgacccacgggctttcgtgcggcttgtcgttcgggcccaggccatgatggtggtcatgcgacacctcttcttcatcgctgtcgccatgatgctcgtggtgcgaaccatggttctgcatccagcgttccttgccgtggaagaccaggaaatacatgcggaacgagtagaaggcggtgatgaacacgccagccaccacggcgaaataggcgaaaccggctgcggacagatgcgaagcggcgaccgcttcgatgatcgagtccttggagtagaagccggagaagaacggcgtgccgatcagcgccagcgaacccaccagcgaagtgatccaggtgatgggcatgtacttgcgcaggccgcccatattgcgcatgtcctgatcgtggtgcatgcccatgatcacggaaccggcgcccaggaacagcagggccttgaagaaggcgtgggtcatcacgtggaacatcgccaccgagtaggcggacgcgcccagcgcaacggtcatgtagcccagctgcgacagcgtggagtaagccaccacgcgcttgatgtcgttctggacgatgccgaggaagcccatgaacagcgcggtgatcgcgcctgccaccatcaccacgttcagcgcggtgtcggacatctcgaacagcgggctcatccgcgacaccatgaagatgccggcggtcaccatggtggccgcgtggatcagcgccgagatcggggtcgggccttccatcgagtcaggcagccacacgtgcagcgggaactgcgccgacttgcccatcgcgccgatgaacagcaggatgcaggtgacggtcagcagcgaccattcgtggcccgggatgatttcgatggtcttgtgcgccagcgccggagcggcggcgaacacatcgctgtagttcagcgagccgccgaagtaggccagcaccatgcctatgcccagcaggaagccgaagtcgccgacgcggttgaccaggaaggccttcaggttggcgaacaccgcggtcgggcgcttgaaccagaagccgatcagcaggtaggacaccaggcccacagcttcccagccgaagaacagctggacgaagttgttgctcatcaccagcatcagcatcgagaaggtgaacagcgagatgtagctgaagaagcgctggtagcccgggtcttcctgcatgtagccgatggtgtagatatgcaccatcagcgacacgctggtgaccaccaccagcatcatcgcggtcagcgcgtccaccaggaagcctaccgagaactcgtagccccctaccgtcagccaggtgtagaccggtccgttgaacacttccgcgcttccattcaggaagcccagaagcaccttgagcgacagcgcggcggaaaccgccacgccggctatcgtgacgacgtgcgaagcgcgccgtccgatcgcccatccaaacaggcctgcaatgatggaacccgccagcggagcgagtgcaatcagcaggtataagctcttcatatccatgcttttgtgctttttaaaggttccggtttgccttagcccttgaggctgcccaagtcttcaacgttgatgctctgcaggttgcggaacagcaccaccagaatcgccagaccaatggcggactcggcggcggcaaccgtcaggatgaagaatacgaagatctggcctgccgaatccgacaggtaatgcgagaacgcgatgaagttgaaattcaccgccagcagcatcagctcgatggccatcagcagcacgatcaggtttttccggttcaggaaaatccccaacacgctgatggcgaacaggatggcggccagcaccagaaagtgagtcagtgtcagcacgtttcctcccttgtggttgattggccgtcaggcctgttgctcaccggaatcggccgcggcctcttccacttgttttacggcatccatcttgacgatgcgcacgcggtcttcgcggcggaccttcacctggatggccggatcgatcgccttgctgtctttgcgcgcgcgcatggtcaggccgatggcggccaccatggccagcagcagcacaacggcggcgatttcaaacggcagcaggtaggtggtgtagagctgatggcccagcaccttgacgttgctgtagtcggcggccagcggcgcggcggccttgaactggccgaggccggttgccgggctcatcaggatcagcgccatctcgaacaccatgatggcgccgaccagggcggccaccggcaggttgttccagaagccttcgcgcagcttctcgatattgatgtccaacatcatcaccacgaacaggaacagcaccatcaccgcgccgacgtataccagcaccagcgtgatcgccaggaactccgcctccaagagcagccagtggccggcgctggtgaagaaagccagcaccaggtagagcacggcgtgcaccgggttcttggccgtcaccacgcgcagggcggcgaagatcagaatggcggacagaacgtagaaaattaccgttgtaaggttcatggcctccccttagcgatacttggcgtcggctgccttgttggcagcgatctcggcctcgtacttgtcgccgatcgccagcagcatcggcttcgtgtagtagaggtcgccacgtttttcaccgtggtattcgaagatgtgggtttccacgatcgcatccaccggacaggcttcctcgcagaagccgcagaagatgcacttggtcaggtcgatgtcgtagcgcgaggtgcggcgggtgccgtcttcgcgctgctccgattcgatgctgatggccagcgccgggcacaccgcctcgcacagcttgcaagcgatgcagcgctcttcgccgttggcgtagcggcgctgcgcgtgcaggccgcggaagcgcggagacagcggggtcttctcttccgggaactgcaccgtgatcttgcgggcgaagaagtagcggccagtgaccatcaggcccttgaccagctccaccagcaggaaggtcttgaaaaagttgcggatcgaattcattttttcacctatcccctgtctcaatgagtccagatggacagcggggtaaacatccacacgcccaccaccaggatccacaccagggtcaccgggatgaacaccttccagcccaggcgcatgatctggtcatagcggtagcgcgggaaagtggcgcggaaccacaggaagcagaacagcaccagcgacaccttgatcgccagccagtggaagccgccggcgcccagcaggccccacgaagccgggaacggcgacagccagccacccaggaacaggatggcggtcagcgcggcgaccaggatcatgttggcgtattcggccaggaagaagatggcgaaggccatgcccgagtattccacgtggaaaccggcgacgatttccgactcgccttccgccacgtcgaacggggcgcggttggtttccgccacgccggagatcaggtagacgatgaacagcgggaacagcggaatccagttccacgacacgatggagccgccgcccatgccgaacgactgctgcttgacgatgtcgaccaggttcaggctgccggacaccatcagcacgccgaccagggcgaagcccatcgccagctcgtaggacacgatctgggcggcggaacgcatcgcgccgaggaaggagtacttcgagttgcccgcccagccggcgatgatcacgccgtacacgcccatcgaggtcagcgccaggatgtacagcagcgaggcgttgacgttggccaccaccaggtgctcggtgaacggaatcaccgcccaggccgccagcgccgggccgatggccagcaccggcgccagcaggaacaagcccttgctggagttggtcggcaggatgatttccttcatcagcagcttgaccgcgtcggcgatgggctgcagcagaccgaacggaccgacccggttggggccgatacggatctgcatgtagccgatcaccttgcgctcggccagcgtcaggtaggcgacgcagcccaacatcggcagaacgatggcgacaatcttcagcagggtccagaccaggagccccgcttcattgccaagaataccttgcaagaactccatggcttacccctgcttgatctcgattgcgtcgaacatgccgccgagctgcagcgtcgctgcgtgcgcggtggccacccgtaccacgtcggccggcaggctgtcgtcggcttccagcgcgacgcgcgcctcgcccgcgccctgcttcagcaccacggtgctgccggcggcgatgcccagcttctgcagcaggctgccgtgcgcgcgtgccaccggggccttggcctcgttggtggcttgcagcgacggcgcgcggcggcagatggcgtcggcctggtacatcggcacttcgccgacgcggacgatgccggccgcggcggccggttgcgcggccactgccgacagcgcgttgttcagcgcggccgccaggttgccggcggcgaactcggcgcgcacttcttcggcgctgttgtagtcgaagcccggcaggctcagcatattgcccagcacgcgcagcaccttccaggccgggcgggtttcgcccagcggacgcaccacgccattgaaggtctgcagcttgccttccatgttgacgaaggagccggcggtctcggagaacggcgcgatcggcagcagcacgtcggcgtaatccagcaggccctggcccttataggcggtcagcgcgatcacggtggcggcctgcttcatcgcggccacggcggcctggctgtcgtagctgtcgaattccacttcggtgttcagcagcacataggctttgcgcggcttggcgatcatcgcggcggcgttgtcgccggcgttgacggcggagccgagcgcgccgcgggtcggcagcgcgccgaccagttcggcgcccacgctgttggcggcttcggccagaatgccgaaacgcgcgcccgacaggcgggagatttcctgcgccagcgacagcagctggccgtaagccggatgatgctgggcgacgttgcccagcacgacggacgcggtttccgcgccggtcaggctttcggcgatgcggcgcgcttcggccgatgcttcaactgcggccagatcgatgccggtcgaacccgacttgatctcggccacggccttcagcacctgcgacagcgcgttcaccagcgccagcggcgagacgatcagcttgcccttgatctgggtcagcaggttgtcgtcggcgacatggataatgttcagctcgccgcccttcttcaccgattggcgcagacgggaagccagcagcggttgttccttgcgcagcgtggagccgaccaccagcaccgacttggcggcagccagttcggcgatggtggagcccagccattcggcgccctgcttggcgctgtcggccgagaagtcgctgcggcgcaggcggtagtcgatgctgttgacgccgaaggcgcgcgccagcttctgggccaggaacagctcctcggtggtggagtgagggctggtcaggaagccgatggcgtccttgccgtgatcggcggacacgccgttcaggcccttcaccacgtattccagcgcggtttcccagtcggtctcgtgccacttgccgtcgaacttgatcatcggcttttgcaggcgctcggcgctgttcaggccttcatacgagaagcggtcgcggtcggcgatccagcattcgttgatggcgtcgttctccagcggcagcacgcgcatcacttcgttgctcttcacctggaccaccaggttggagcccaggccgtcgtgcgggctgaccgacttgcggcgcgacagctcccaggcgcgggtgctgtagcggaacggcttggaggtcagcgcgcccaccgggcacaggtcgatgacgttgccggagatttccgaatccacggtcttgcccaggaagggcaggatttccgagaattcgctgcggttggccatgccgatttcctggaagccgcccacttcttccgtgaagcggacgcagcgcgtgcagtggatgcagcgcgacatttcctcggcggaaaccagcggacccatatccttgcccaccaccacgcgcttctcttcctcgtagcgcgaggtggagttgccgtagccgaccgccagatcctgcagctggcattcgccgccttggtcgcagatcgggcaatccagcgggtggttgatcagcaggaattccatcacgccctgctgcgccttcttggccagcggcgacgcggtatggaccttcatgccgtcggtcaccggcgtggcgcaggccggcagcggcttcggcgccttttccacttccaccaggcacatccggcagttggccgcgatggacagcttcttgtggtagcagaagtgcggaatgtaggtgcccaccgagtgggccgcctcgatgacggtgctgccttgcggcaccgtcagttttttaccgtcgatttcgatttcaagcatcgctcaacaccatttgtggtccaccaaggtctttccgtgttcgatcgcgtactcgaactcctcgcggaaatgcttggtgaaactgcgaaccgggaacaccgcggcgtcggccagcgcgcagatggtgcggccggccatgttgttgcccacggaatccagaagctccagatcgcccttgcggccctggccgttggcgatgcggtggatgaccttgtacagccagccggtgccttctcggcacggcgtgcactggccgcaggattcctcgtgatagaagtaggccaggcgctccagcgccttgatcatgcacacgtcttcattcattacgatgacggcgccggagccgagcatggagccggccttggcgatgctgtcgtaatccatcgtgcattgcatcatcacgtcggcgggcagcaccggagcggacgagccgcccgggatcaccgccttcagcttcttgccgtccttcatgccgccggccatttccagcagcgcgctgaacggcgtgcccagcggcacttcgtagttgcccggacggttgacgtggccggacaccgagaacagcttggtgccgccgttgttcggcttgccggcttccaggaacttctgcgcgccgtcgcggatgatgaacggcaccgaggcgaacgactcggtgttgttgatcgtggtcggcttgccgtacaggccgaagctggccgggaacggcggcttgaagcgcggctggcccttcttgccttccagcgactccagcagcgcggtttcttcgccgcagatgtaggcgccgtagccgtggtgggcgaacaggtcgaagctgaagccggaacccaggatgttctcgccgaggaagcccgccttgcgcgcctcttccagcgcttcttcgaacaacacgtagtcttcgaagatttcgccgtggatgtagttgtagccggccttggtgcccatcgcgtaaccggcgatgatcatgccttcaatcagcgaatgcggattgtagcggatgatgtcgcggtccttgaaggtgcccggctcgccctcgtcggtgttgcagacgacgtacttgtcgcccgggaacgagcgcggcatgaagctccacttcaggccggtgggaaagccagcgccgccgcggccgcgcaggccggagttcttcacttcggcgatcacgtcctcttgcgccatcttgcgctcgaggatgctgcgcagcgcctggtagccgccgcgggccacataggcgtccagacgccagcagtcgggctggctggtatcgacgccgtcgaaaattacgccattgacgaagactgccattatttcaactccgccagttttttatcgatggcttcggccgtcatgaagctgcacatcttgtggttgttgaccagcaagaccggcgcgtcgccgcaggcgcccatgcattcgccttccagcagcgtgtacttgccgtctgcgctggtctcgccgatggcgatgccgagcttctgcgaaatgtactgggcggcgttgacgccgccttgcaaggcacagggcagattggtgcagacggtgatcttgtactggcccaccggcttcatgtcgtacatgttgtagaacgtggcgacttcgtaggcggccaccggggcgatacccaggtagttggcgacgaactcgatgatcccggtgttcaggcagcgctcttccggcgtgctgccgctctcgcggcgctcctccagcgcgatgcgcagcgcgcccatcacggccgagcgcttctggtctgcgggatatttggcgacctcgcggtctatcaatgctaacgattgtgcggacagcatcagcggtcgatctccccaaatacgatgtcctgggtaccaatgatggcgacgacgtcggcgatcatgtggcccttggccatctcgtccagcgccgccaggtgggcgtagcccggcgcgcggatcttcaggcggtacggcttgttggcgccgtcggataccagatagacgccgaactcgcccttcgggtgttcggtgccgacataggcctcgccttcgggcacgtgcatgccttcggtgaacagcttgaagtggtggatcaggtcttccatattggacttcatgccttcgcgcgaaggcggcgccactttatggttgtcggtgatcaccgggccggggttggcgcgcagccaggccacgcactgctggatgatgcggttggactggcgcatttcttccacgcgcaccaggtagcggtcgtagcagtcgcccttcacgcccaccggcacgtcgaagtccatcttgtcgtacacgtcgtacggctgcatcttgcgcaaatcccaggcgatgccggaaccacgcagcatcgggccggtcagacccagattcagcgcgcgctcgggcgtcaccacgccgatgcccacggtacgctgcttccagatgcggttgtcggtcagcagggtttcgtattcgtcgatgtagccggggaaacggtcggtgaaatcgctgatgaagtccagcatcgagcccttgcggccttcgttcaggcgcgccagctccttggcgttcttaatcttggacaccgtgtactgcggcatgctgtcaggcaggtcgcggtacacgccgcccgggcggaagtaagccgcgtgcatccgcgcgccggaaaccgcctcgtagcagtccatcaggtcctcgcgttcgcggaacgcgtacaggaacatggtcatcgcgccgatgtccagcgcgtgggcgccgatccacagcaggtggttcagcacgcgggtgatctcggcgaacatcacgcggatgtactgcgcgcgctccggcacctcgatgcccatcagcttttcgatggtcaggcagtaggcgtgctcgttgcacatcatcgacacgtagtcgagacggtccatgtacggcagcgactggatgaaggtcttgtgctcggccagcttctcggtgccgcggtgcagcaggccgatgtgcgggtcggcgcgctggacgacttcgccgtccagctccagcaccaggcgcaatacgccgtgcgcggccgggtgctgcgggccgaagttgagggtgtagttacggatctcagccaccgtagttctcctcgcggatgatgcgcggcgtgatttcgcgcggttcgatggtgacaggctgatagatcacgcgctgctgagtcgggtcgtagcgcatttccacatggccggacagcgggaagtccttgcggaacgggtggccgacgaaaccgtagtcggtcagcaggcggcgcaggtcggggtggccttcgaacacgatgccgtacaggtcgaacgcttcgcgctcgaaccagttgacggcgttccagatgccgttgaccgacgcgacgaccgggaaggagtcgtcttcggcgaagacgcgcaggcggatgcggtggttcagcttgaccgacagcaggtgatagaccacggcgaagcgcggaccgtcccacggctcgtcgcggtaggcgctgtagtccatgccgcacaagtcgatgcactgctcgaaagcgagttcggcgtgatcgcgcagcgtctcggccacggacagcaggtccgcggccttgcacacgatggtcagctcatccagggccagcgtgctgcgcacgagcttgtcgcccagcgccgcggcaacgaccgaacccagcgcttccattttcttggaggccataagtttctaccttagcgggcgatggtattggtacgtttgatcttgttctgcagctggatgatgccgtacagcagcgcctcggccgtcggaggacagcccggcacatagacatcgaccggcacgatgcggtcgcagccgcgaactacagaataggaataatggtaatacccgccgccgttggcacaggagcccatcgaaatcacccaacgcggctcggccatctggtcgtagaccttgcgcagcgccggcgccatcttgttgcacagcgtgccggcgacgatcatcaggtcggactggcgggggctggggcggaacacgatgccgaagcggtcaaggtcgtagcgcgccgcgccggcgtgcatcatttccaccgcgcaacaggcgaggccgaaagtcatcggccacaaggaacccgtgcgggtatagttgataagtttgtcggccgtcgtggtgacgaagcctttctccagaatcccttctactcccattccagagctcccttcttccacatgtagacgaagccgagcgtcagcacggcgagaaattcgaccatcacgcccaaaccatagacgcccagatccttcaacaccacggcccacggaaacaggaaggcgatttccaggtcgaacaggatgaagagaatggcgatcaggtaatagcggacgtcaaacttcatgcgggcatcttcgaaggcctcgaagccgcattcgtatggagaaagtttctcagagtcgggacgattcggcgccagcaatttgcccaatgcgatagggcccacgccgaccagaagtccgacaatgacaaacatcagaatgggaaagtagttttgcagcatttcccgtacacccccaaaaaaagaggggtcaccccccctaggctccaaataaaacaggccaccggagtcccggtggcctgtttttgaatggtggtgccgacagtgagactcgaactcacacagctttcgccactaccccctcaagatagcgtgtctaccaatttcaccatgtcggcacagcaaagctttaaattgttactccgggatcttggaagctgggcccgaagctttgttattaggcgcgcctgccgggatttgcggcgcaacctgttcaatcttgccacccatcacgcccagattatcttttccacccccggaaagataagccagcgccatggaagtcgagaagaacaccaccgctgcaatcgcggttgttctactcaagaaattcgcagaaccagacgcaccgaacagactgccggacgatccgctaccgaaagccgcgcccatatcggcgcccttgccgtgctgcatcagaacaaggacgatgatacccgctgcggacagaaggtttacaatccaaataagcgtcttgagaagttccatactatatcatttttcctgcggcttggcaaatcactctgaatgaacgggcgtccagagaggcccctccgaccaatgctccgtcgacgttttccgtcgccaggatggactcggcgttctctgctttgacactgccgccgtagaggacgcgaatcttagccgagcctcccgcgttttgcaagcaccaatttttgatgaatgcatggatctcggcgatctgctccagggttgccaccttgccggtgccgatcgcccataccggctcataagccacgacgtattcatcaccatggccgatctcagccagaagcgcaagttgcccgcgcaccacttccagatactgccccgcctcgcgctgttccagggtttcgcccacgcacagcacaggcactaggccggcggcgatcgcgtggcgcatcttcttcaacagcgaggcgttgtcctcggcgaaatactggcggcgctcggaatggcccaccagcgcatagcggcagccgacgtcggccagcatcgcggcgctcacctcgccggtgaaggcgccgtccgcgtcgtagcggctgacatcctgcgccgacaaggcgatgtggcttccgcgcagctgcgcggccagcgcggccaggtaaaccgccggcgcggcgatgccgacgccttcgcgattggtgtcctgatccgccagcagctccgccgccagccggcccgcgctgtcgccgcgggtattcatcttccagttgccaatcaccaacttgccggacatcgaaatctccacgaaatggttgtcggggcggattatacctcgccgcggaaagcgcaccaacgtcttcagctcaagcgatttacgacttgtaatattactgcaaaatttcggctatacgatggcggccatcacaacagcagtcccattacatcgttcgggagttaagcatgaaacagtctgtacgtctggcagcggctcttggttccgtcatgatcgcgggttcggtctatgcggccgacatcaccggcgccggcgcgaccttcccctacccgctgtacgccaagtgggccgccacctacaagggcaacaccggcaacaacatgaactaccagtccatcggttccggcggcggcatcaagcagatccagtccaagactgtagacttcggcgcgtccgacatgccgctgaaacccgaagagctggagaaatccggcctgacccaattcccgaccgtaatgggcggcgtggtgccggtgtacaacatcccgggcatcgccgccggccagatcaagttcaccggcccgctgctggccgacatctacatgggcaaggtgtccaagtggaacgacgccgccatcgccaagctgaacccgggcgtcaagctgcctgaccagcgcatctcggtggtgcgccgctccgacggctccggcaccactttcattttcaccaactacctgtccaaggtttcgccggaatgggcgaaggatgtcggctccaacaccgccgtcagctggaagggcagctcggtcggcggcaagggcaacgaaggcgtcgccaactacgtgtcgcgcatcaagggcgccatcggctacgtcgaatacgcgtacgccaagcagaacaagctggcctacggcctgctgcaaaaccaggccggcgccttcgtgaagccggacgaggcatcgttcaaggccgccgccgccaacgccgactggaaaaaggccccaggcttctacctgctgttgaccaaccagccgggcaaggccagctggccgatcgccggcgccaccttcatcctgatgcacaagaagcaggataagccggctcaagccgccgaagtgctgaaatacttcgactgggcctacaagaacggcgacaagaccgcgcaggagctggactacatcccgatgccggacaacgtcaagaccgtcatccgcaccagctggaagcagatcaccgacgccagcggcaagactgtctggaactgacaagccgaagccatactagctgtcacccaggccggggagagtcgactctctccggccttgtgtctgaaccatcaagaatcgacacatgcaaaaactgagcaatgagcagcagatgaattaccagatgctgctggacaagctgttccgcatcaccacccgctgcttcgccttcctggtgctagcgctgctggtgggcatcctcatttcgctgctgatcggcgcgatgcctgccatcaaaggcttcggcctgggctttttgaccagcaccgactgggatccggtccagcagaaattcggcgcggtggtgcccatcttcggcacgctggccacctccatcatcgcgctgctgattggcgtaccggtcagcttcggcatcgcgctgttcctgaccgagctatgccccacctggctgaagcggccgctgggcatcgccatcgaactgttggccggcatcccgtccatcatctacggcatgtggggcctgttcgtattcgcgcccttcttcgccgaccatatccagccgtgggtgatagaccacctcggccccttcccgctggtgggtttcctgttccagggcgcgccgatgggcatcggcctgttcaccgccggactgatcctggccatcatggtgattccgttcatcgcctcggtgatgcgcgacgtgttcgaagtagtgccgaccatgctgaaagaatccgcctacggcttgggctccaccacctgggaagtggtgcgctacgtggtgctgccctataccaagaccggcgtggtcggcggcatcatgctgggcctgggccgcgcgctgggggagaccatggcggtcaccttcgtgatcggcaactccacccgcttcgccgccagcctgttcgagccgggcaactccatcgcctcgtcgctggccaacgaattcgccgaagccaacggcgacctgtacatgggctcgctgatcgagctgggcctgatcctgttcttcatcaccttcgtggtgctcgcctgctccaagctgctgctgctgcgcctgaagaagcaggaaggccagccttcctgatatgaaagacgccacaccgatgagtccaagccccatgtgcgaagcccttccgcgcgccagcgcgcccgtcagcctgaagcaggacagcctcacctaccgccgccgccggctggtcaaccgggtgaccatggcctgctcgatgttcaccatggccttcggcctgttctggctgttctggatcctggccaccctgctgcaatacggcctgtccggcatcgaatggcgggtgttcgtcgaaagcacgccgccgccgggcagcgccggcggcctggccaacgccatctacggcagcctggtgatgaccggcttcggcaccctgttcggcacaccgatcggcatcctggccggcatttacctggccgagtacggccagcgcggctggctggcgccggccacccgcttcatcaacgacatcctgctgtcggcgccgtccatcgtcatcggcctgttcgtctacgaggtgtacgtggtgtcggtcggccacttctccggctgggccggctccttcgcgctggccatcctggtgatcccggtggtggtgcgcaccaccgagaacatgctgcgcctggtgcccaacagcctgcgcgaagcggccatcgccctgggcgcgccgcaatggaaggtgatcctcaccgtcacgctgcgctcggccaaggccggcgtgctcaccggcattctgctggcggtggcgcgcatttccggcgagaccgcgccgctgctgttcaccgcgctgaacaaccagttcttcaacagcaatatgaaccagccgatggccaacctgcccatcgtgatcttccagttcgccatgagcccctacgaggactggcacaaactggcctgggcgggttcgctgctgatcaccttcagcgtgctgaccctgaacatcgtcgcccgctggatgggcggcagcaaaaatcaatcgaattaaggcatgacgaccatggcaagcccctccaccaagctcgaggtccgcaacctcaacttcttctacggcaacttccacgcgctgaaaaacatccagctggaaatcgcgccgcacaaggtcaccgccttcatcggcccgtccggctgcggcaagtccacgctgctgcgcaccttcaaccgcatgtacgagctttaccccggcctgcgcgccgatggcgacatcctgctggatggccagaacatcctggcgcgcgacatcgacgtcaacctgctgcgcgccaaggtgggcatggtgttccagaagcccaccccgttcccgatgtcgatctacgacaacatcaccttcggcgtgaagctgtacgaaaagctgtccaaaggcgagatggaagaccgggtggaatgggcgctgcgcaaggccgcgctgtgggatgaggtgaaggacaagctcaagcagtccggccactcgctgtccggcggccagcagcaacggctgtgcatcgcccgcgcggtggcatcgaagccggaagtgctgctgctggacgagccgacgtcggcgctggacccgatctccaccgcccatatcgaagagctgatccatgaattgaaagaggactacaccatcgccatcgtcacgcacaatatgcagcaggcggcgcgggtgtccgacttcaccgcctacatgtacctgggcgaactggtggagttcggcaagaccgacaccatcttcaccacgccgcagcagaaggcgaccgaagactacatcaccggcaagttcggctgatgccgcaggcggcgggacgcgcatgacgaatcgccatgccgcccgccgcctaccctacgcccaggcccgcgcgcaatgccagcgacatgatgaaaaatcatggacttagccggctggcaagcccgcgctgtcaagttgattttgccgttttcacaggcaaaaccacacggtttattttttttttataaacacttgacgccactggcctggaacacaacaatcccgcctttacgattatcgcagactcgccatgctggacctgttctccgggctcgacacccatgtagccatcactttgatgctttcgctgggcttcgtgctcgcatttgagttcatcaacggtttccacgataccgccaacgctgtcgccaccgtcatctacacccagtcgatgaagccgcgccttgccgtgttctattccggcatctgcaacttcctcggcgtgatgagcggcggcctggccgtcgcctacgccatcgtccacctgctgccggtggatctgctgatttcggtgaacaccacccgcggcatgtcgatggtgttcgcgctgttggcggccgccatcctgtggaacctgggcacctggtatctgggcctgccggcctccagcagccacacgctgatcggcgccatcctgggcgtcggcgtggccaacagcctgatcaaccacacctcgctgtcgcacggcatcaactggggcaaggcggtggacgtcggcgcctcgctgctggtttcgccgctggtgggcgccttggtcgccggcttgatcgtcatcctgctgcggcgcttccgcccgcacagcaacgtgcacaaaaccccgtaccagcgccagcaggtggaaggccgcaagcatccgccgttctggacccgcttcatgctgatcgtgtcggcgatgggcgtcagcttcgcccacggctccaacgacggccagaaaggcgtcggcctggtgatgctggtgctgatcggcatcgtgcccgccaagttcgtgctgaacctggacagcaccccgtaccagctggagcgcacccgcgacgcggcgcagcatctgcagcagttctaccagcgccacgaggcggacctgtccaagatcatcgtcaaatccaccagcaccagccagtacgaatgccacccgcagcaaaccgtggccaccgcgcagaacctgctgaccctgatgggcgacggttccgactaccacaagctgagcgcttcgcaacgctgggacgtgcgcacccagctgctgtgcctggatgacgccgccaagaaggctgccaccctgcccaagctgagctcggacgacaagcagctgctggacaatctgcgcaaggacctgaccaccaccaccgaatacgcgcccacctgggtgatcgtcgccgtggcgctggcgctgggcatcggcaccatgatcggctggaagcgcgtggtgaagaccgtcggcgaaggcataggcaagaaggacatgacctacgcccagggcgtggcggcgcaagccaccgccgcggtgtccatcggcctggccagctggttcggcttcccggtgtccaccacccacgtgctgtccagcggcgtggccggcaccatgatcgccgacaaggccggcctgcagatgggcaccatccgctcgatcgcgctggcctggctgttcacgctgccggcgtcgatggcgctggccggcggcctgtactacctggcggcgcagtggttctgatccccgccgatgtccgacaaaaagccgacgcgcccgcgtcggcttttttcatgcttgatctgcgtcaaggggagcgctggctgcgcttgagccattaattcataaattgctaatattattcggcttcattaatggtttcttttgtttgcagcaaccctccctagccgccgcgatttcccccaatcgcggcggattttttcatgccttgagaaattgctcgcggccagccagccagcgctccagatgcgcctccgcctcgcgcggccagcgctccagcaattgcggcgccagatcgcgcgccgcctccagcagcgcctggtcctgctccaggtcggcgaagcgcagcatcggcaggccgctctggcgcgcgccgagaaactcgccgggaccgcggatctgcagatcctggcgcgcgatctcgaaaccatcgacgttttcgtagatcaccttcagcctggccttggccaggtcggacaaggggctgtcgaacagcagcacgcacacgctcctggcgctgccccgccctacccggccgcgcagctggtgcagctgggccaggcccattctttccgcgtgctctatcaccatcaggctggcgttgggcacatcgacgcccacctcgatcaccgtggtggccaccagcacgtccagctccgccgccgcgaaggccgccatcaccgccgctttctccgccgccttcatccggccgtgcaccaagccgatgcgccgccccggcaagtcctgctgcaattgctggtggctgtccaccgccgtctgcagctgcagcgcctccgattcctcgatcaacgggcatacccaatacgcctgccgcccttcggcgcaggtgcgctccaccagccccaccacctcgggccggcgcggattgccgatcagcttggtgacgatgggcgtgcgtcccggcggcaattcgtctatcactgacacgtcgagatcggcgtaaaagctcatcgccagcgtgcgcggaatcggcgtggccgacatcatcagttggtgcggctcctcgcccttgtcctgcagcgccagccgctggccgacgccgaaacggtgctgctcgtcgacgatggcgaggcccagcttctggaacgccacgtcatcctggaatagcgcgtgggtgcccaccgccagccggcactggcctgaagcgatctcgtccagcgcctgctgcttcgcttttttcctcaggctgccggacagccaggccacgcctatgcccaagggcgccagccagctggacaatttcaggtagtgctgctcggccaggatttcggtcggcgccatcagcgccacctgatagccggcctcgatcgccgacagccccgccagcgccgcgacgatggtcttgccgctgccgacatcgccctgcaacagccggtgcatcgggtgcggcagcgccaggtcggcgcggatgtccgccagcacccggcgctgcgcgccggtaagcgggaacggcagattgcgcagcaggcgctcgctcaggctgccgtcgccgacgatgcgcggcgcgctgccgagccggcgcgcgcggtaggccagccgcatcgacagctgctgcgccagcaattcgtcgaatttcagccgctgccaggccggcagccgcggatcggccagttgctgcgccgaccactccggcggcggctgatgcagcaggcggatcgcctcggcgaacggctgcagcgccagcggctccagtagcggcagcggcagcagctcgtccagcgtctgcaggcgcagctcgccgtgcaccagcttgcgcagcataggctgggtcaggccgttgaccgtcgggtagaccggggtgaggctttccgccagcggcgcgccttcgcgcacctcccgcgtcttcggatgcaccatctcgtcgccggcgaagccgcggcggatctcgcccagcgcccgcacccggctgccttcggcgaactgcttgatctggctgggatagaaatggatgaagcgcagcagcagcgcgccgctgccgtcctcgatctgcaccctgagctgcttgcgcggccggaagctgacctcatgcgacaccacggtgccctccaccagcaccggctggccataaggcgcgtcggcgatcgggtacagatgggtttcatcctcatagcgcagcggcagatgcagcaccaggtcgaagcggcggcgtatgcccagcttctccagctttttggccaacgcagccggcaccgcgggcggctggttggcgagatcgatcggcggagtcatgaggacagattgtactcaagaatgcaaaaggcggaagcggctcgcgccgcttccgccttgtcgtttggccagcaagccgtcagcttattgctggcgctcccacacctgggaacggaagaacggaccgatgtagccgcgcacgcgcagcttcttgccgtcttccatcagcttggcgccggaggtgtagatcttgccggacttcgggtccaggatctggccgtcgctccattcgtcgccgctctttttcagaccccacaggatctgcatgccgttgaccggcttgcccttgttggcgccgtcgcacttgtcgcacaccgcctccgggtgcaggtagagcttgatcaccttgccggtcagctcgccgttggggctttcgttgatctgcaccagcgccttggcctggtgggtctcgtcgtctatggtcttccacaggccggcggcgctgccagccagagccaattggctggccaggcccagcgcggtagccaggcaagcggctttggcgattcgaatcatgatgttttcctcgtcttgtttgttatgaaacagcagtttggagtagcggctctaggatgccaacagccggccgcatcgtcaagccgccgcgcgtttcacagcgtgaattcgccgctgccgaccgcctgcgcccggccgcccacctcgacccgccctgcggcgtcgacatccaggtacagcacattgggccgccctatcgcctcgccctgctccagccgccaggacagcggcgcgaggccgttcagcgcgcaccagccgcccaagttggcgcaggcgctgccggtgcccgggtcttctatcaccgagccttgctggtcgaagaacaagcgcacggtggcgacgccgccctgctggtgccacaggtaggcgatgctgcggcccgggtgcaaggtggcgtggcggcggaacagctccggctccggccgcgcgcgcagcaccgcctcgcggctggagaggccgatcagcagctgctcgctgccggcgttcagccattgcggcggctgggcgatatcctccggcgccaaacccagcatggcggccgccgtgtcgctgccgaagccggccgcccgcacgctggcgggcagcgcgctcaagcggaacaggccgtcctgatgccggatggggatcagtccggaacgggtgcgcagcgcgaagctgtcgcccagcccgccgcgggcgtgcagcgccgcggcgctgcccagcgtcgggtggccggcgaagggcagctcgtagctgggcgtgaagatgcgcaggctggcggcagcttcggcgtcgccgggaaacagaaacacggtttccgacaggttgaactggcgcgcgatcagctgcatgtcctggtcggacaggccggccgcttcgggaaacaccgccagcggattgccgccgaagcgctgctcggcgaacacattgacaagctcgaaacgataagtcgccatcaatcgtccttatataaatgacatgcgcgatcctgcatctgatcttccaccttggcaaggcggaacttcaagcgctccagttcgctagccgtctgcccctggcgcaggccttgccgcaacgacgcctgcttgcccgccaagcgctggcaatgctggcgctccgccagccatttcttgcgtccggccagcctctcgcgctgcgcggccagctcttccgcctggcgcgccttgtcgcgccggcctgaccaatcccgcagcgactggcggtattgctgccgcgccgcgcgctggctgtcgccgccgtcgatcacgctgagcggcgcgctgccatccatcgccaagctgcggctgcccgccggacatggctgctggctgtagctgatgccgccgtccgcatcgcggcacttgaatacctgcgcctggcagcacaccgccgtccatcccaggcaaaccagtaagactgctttcatcgcgcgctcccggctattcgttccgggcaacatgccaaatcccggcggcgccggacactggctactcggtcaaggccgccaggccatccggacagcaaaaagccccggaccgttggcccggggctcgagacttgcggatcaaggaaacgcttacagcaccatcaccgcttcggcttccaccagcacgcccttgggcaggctggccacgccgacggcggcgcgcgccgggtaaggctggctgaagtattgcgccatgatttcgttgaaggtgccgaagttggacaggtcggtcaggtaggcgttgagtttgacgatctggtccaggctgccgccggcggcttcgcacacggctttcatattcttgaatacctggtgggtttccgcggcgaagccgccttccaccacggtcatgctggccgggtccagcgggatctggccggacaggtagacggtattgccagccttgacggcttgcgagtaagcgccgatggcggccggggctttgtcggtgtggatgatttctttagccattattcatctccttctttgaggaacagggtgagcaaatcgttgaggaagcgctggcctttcagcgttgggcgcaggatcgcgccgtcatcgtccagcaggccttgcgcctgggcttcgtccagctggcggcggatcgacgccagcggcagcccggtgcgctcctggaacaggcggctctcgaagccgccggtcaggcgcagcaggttcatcatgaattcgaacggcaggtcggcgcgggcaaccttttgactgctctgcaacggcgcgccatccgccaccgccttcagataggccgccggctgcttgtgccgcatctggcggacgatgccggcgtggctgctgatcttgccgtgggcgccggcgccgatgccgacgtagtcgccgaactgccagtagttgagattgtggcggctgtggcggccgggcttggcgaaggccgaggtttcgtagtgatcgaaaccggcggctgccagacaggattctatcgcttcctgcatatcggccgacacctcgtcgtccggcaagttcttcggcgtttgcgccgcgaacatcgtattcggttctatcgtcagatggtaggccgataggtgagtgatgccgtaggacagcgcggtgttcaggtcggacagcgcctggtccagggtctggcccggcagcgcgtacatcaggtccaggttgacgttgtcgaagtaggtcagcgcgatctcgaccgcgcgcttggcttcgtcgccgtcgtggatgcggcccagcgcctgcaaatgcttgggattaaagctctggatgccgatggacaagcggttgatgccggcctcgcggtagccgcggaagcgctcgatctcgaaagtgccgggattggcctccatcgtgatttcggcgtccggatgcagcttcatccgcgcgcgcaccccggccaggaaggcatccatcgcctgcgggctgaacaggctgggcgtgccgccgcccatgaagatgctggtcagcggccggccccatacttcgggcaggctgaattccagatcgcgcaacagcgcgtcgacataggccatctcgtcgaagccgttcttcggctcgtgggaattgaagtcgcaatacggacacttgcggatgcaccacgggaagtggacgtacagcgccaggggcggcagctcgcgcaggccgcccgtcagcgccgacagatcgatcacgctcatgccagcgccttcagcttggccatcagtgcggccagcgcctggccgcggtggctgacgcggttcttttcggcggcgtccagctcggccaccgacacgccgtggctgggcaggaagaagtaagggtcgtagccgaagccgccttcgccggccgcctcgtcacgcacttcgcccagccagatgccgtcggccaccagcggttgcgggtcatcggcatggcgcaccaacaccagcacgcagtagtaccaggcgcggcggttggcctcgccctgcagcttttccaccaacagcgcgttgttgcgcgcgtcggacttgggctcgccggcgaaacgggccgaggacacgcccggcgcgccgcccagcgcctcgacgcagatgccggaatcgtcggccagcgccggcaggccggtcagccggctggcgtggcgcgccttctccagcgcgttctccaggaaggtgtgatgcggctccgggcactccggcacatcgaagtcgcgctgcgggcgcacggtgacgcccagttcggcgaacagcgcgccgaactccttcagcttgccggcgttattgctggcgagaaccaattgatcgaacatttcttcgctctttctatcttgtgggtgcggccgaaccagcccaatggcgtccggccaggacgccagcttagcggctgaccttcacttccgtccacatccgcgccaaggaacgacgttctttcggtgtcagttcgcgcaagaccgtccatctcttcgcctgttcggccgtcggattgatcactgggctggccttcagatcggcgcggaagtagccgctggcggtggccaccgggttggtcgcgccattgaggttggtcaactgcgccgcgttctggccgtccagcatgaaattgatgaactggtgcgccaaatccggccgcttggcgctggcggtgatcgccatggtgtccacgccgatctcgttgccttcgcgctgcggcgcattgccgatatggaagggccgcttggtctggcgcgcgtcctcgctggcctggaagaattcggtggaatagcccagcgccacccagatattgccgaccgccagctgcttcagatagctggcgttggagaaggcggcccagtacggcttggcctgcttgatcacgtcgcgcgcggcgcgcatgtcggcgtcagtcgcggtattcggatctttgcccaggtagaacaaggcggcggcgaacacctcgcgcgagctgtccagcaccgtcaccttgcccttgatcttccgcagcaccttgggatcgaagatcaccgaccagctagttgggtccacgcccaactgcttcagcttctccacgttgtatcccaccgacgtcagcgacagcacggtggggatggtgtagctgttgtccggatcgtagctttgcgacagataggccggcgccacgtttttcagattcggaatctggcggtggtccaagggttgcagcagcttctgcttggtcatcgcctgcacgacgaaactggagggaaacaccatgtcgtagcctttggcgccggcggccagcttggccagcatttcctcgttgtcgccgtagtagtcctgcaccaccttgcagccgcagcgcttctcgaactgtctgacgatgttgtcggacagcgagccgctccagttgtagatgtgcagcacgtcgctaggcccggcgtaagccaggctggtggacatgctcagggccagcatcaacttttgcaactttttcacttgggactcacctccagacggtcatgccgggcatgacaacaatgacaaaaggcggccggggccgcctgccgaagacagccgctcgtcggcggccatcggataatcaggcgcggcggcccgccagagtcgcctcgtaggcctggcgcagcaggccggcatcggcgccgtccaagagcttggagtcggacagcatccgccgccagttgcgcgcgccgggcaggccctggaacaggcccaggatgtggcgggcgatgtggcggacattgctgccgtcgcccagacgcgccgccacatagggcatcatcgcctccaccaccgccgcgcgctcggggccggcggccgcgtcgccgtagaactgcgcgtcccactcggccatcaaccacgggttgtgatacgcctcgcggcccaccatcacgccgtcgacgtgctgcagatgctcggcgatctcggcattggtcttgacgccgccgttgatcaggatttccagctccggcctctcccgcttcagccggtagacgtagtcgtacttcagcggcgggatctcgcggttttccttcgggctcaggcccttcaggatggcgttgcgcgcatggacgatgaaagtgcggcagccggcctcggccacggtgtcgacgaattcgcgcaggtaatcgtaatgctcgatctgatcgatgccgatgcggtgcttgacggtgacgtcgatgcccacggcatcgcgcatcgccttgacgcagtcggacaccagctgcggctccgccatcaaacaggcgccgaaagcgcccttctgcactctctcggacgggcagccgacgttaaggttcacctcgtcatagccccattgctccgccagcttggcgcaggcggccaactcggcaggctcggagccgcccagctgcagcgcgactggatgctcggcctcgtcgaagcgcagatggcgcgcgacatcgccgttcagcaaggcgccggtagtcaccatctcggtatacagccaggtgtggcgggtgatctggcgggcgaaataacggtagtggcggtcggtccagtccagcatcggagcgacggacagacgccgcggcggcaacgcgcggcgggtggcaaacgtttgattcatccgggaaaaccaattcttcgcagcggcaaaacgcgcggcctggccggacacgctgcgacgcataagcgtttgatcaaactgggaattatcctacctacgccaaggcagggtcaaggcgaaacctccccgcgctcactcgatcagccgcatatgcgcgcgcacccagtcgcggtcgtccgcttcgaaatgccaccactcggtggcgatggcgcggaagccggcggcctccatgcagccgcgcagcagcaggcggttggccagctgcgcctcgctcaggcggccggccgcccgcatttcggcttcgcgctgcggctgcgccagctcggtgaaatcgtcgaaaccggtgcccatgtccagctcgcgcccctcgccgtcctcgatgcccagatccaccgccatgccgaagctgtggatggagccgcgcgccggatcggcgacgtaaatgcgttgcggcgtgtccttgacgatctcccacagcacgcgctgtacccgcccggggcgcaaggcgtcgaaaatgcgcagcctatggccgggaagccggcgccgcagttcccgcgcggctgcggccagcttgccggcggcgcggcggtgcaacagcgcgcaggccgtcccgccgtagagatcgcgccccacgaagttgtcgctgccggcataacgcaggtccaggctcaaaccgtcgatgccggcaatcgacacatattccggatgcgccgccagcgcttccatcgccatcgtttccgtcattagcctccgctcccgccagtcgaacccgattgcgtagtatgcgataattccatgcgcattcgatgcggatgcgccgtcaagccatgccgggcgcaaacccgcaggccaaaatcatgataatccgcggcaagcgaaacctgaacaggaagcggaaatgaccctgccccccctcctcaaaaccctgtgtctggcggcgctgctggccggcgcgctgcccgcggcggcatcggcggccaaaccgctggtcttctgcgccgaggcctcgccggaaggcttcgaccccgcgctgtgggacagcgccaccacctacaacatcaccaagccggtattccagggcctggtcgagttccagcgcggcggcgtggcgctgcgccccggcctcgccgaaagctggaccgtgtcgccggacgggctgaattacaccttcagactgcgccgcggcgtcaagttccaccagaccgcctatttcacccccagccgcgacttcaccgccgacgatgcggtgttcaccatcagccgctggatccgccccgacctgccgttcaaccaggcgttcaaaacgccgttgaccgggccggacggctacggcctgtccaagctgatagagtcggtgcagaaagtcgatgcccgcaccgtgcgaatccggctgaaggagcgcaacgccaccttcctcaccttcttcgcgatgggtttcgccggcatgcagtcggccgaatacgccgagcagctgctgaaagccggcaagccgcaacagatcaaccagctgccgataggcaccggcccctaccgcttcaagagctacgccaaggattccatcatccgctatgaggccaatccgcagtactggggcaaaccgcagaaaacccgcgacctgatcttcgccatcgtcgccgacccgcaggtgcgcatccagaaattgaaggccggcgaatgccaggtggccgccgcggtgcgcgagtccgacctcgacgcgctgtcctccgacaaaaacgtcaagatcgcctccaccggcgccagcaacatctcctacctcgcctacaacctgaagcggccgcaattcgccaagcgcgaggtgcgggtggcgctggacatcgccatcaaccgcgacgcgctgttcaaggcgctgttccccaagggcggcgccacccaggcggtgaatcccttcccgccgtccacctggagctggaacccgcgcacccgcaacgagtacgacccggccaaggcgcgcgcgctgctggcccaggccggctaccccaacggtttcaccgtcaacctgtgggccttgccggtgcagcgccccaccaatcccaacggcaagctgatggcgcagatgatccagcaggactgggccaggataggcgtcaaggccaatatccagtcctatgaatggggcgaatacctgaaacgcgccggcgccggcgaacacgacgtctacatgtccggcctgacgagcaactccggcgacccggacgacttcctgtggaacagcctgtcctgcagcgtcagcaagggcggccagcgcttctgcaacgccgagttcgaccgcctgctgcaacaaggccgccagaccaccgaccagaaaaaacgcgcgcagtactatctgcaggcgcaggacatcttcaaacgcgagcggccgtggatcaccatcgcccattcgcgcatctatatcccgttgcgcgccaatgtgcagggcttcatcatgaatccgaatggctcattcgatttcgaggatgtatggctgaaatgaacccggcctggccgcctggcttcgccagccaccgctaccaagcgttgcggtcggggccgcggctgatcgtcaccggcgcggtgcatggcgatgaaacctgcggcgcccaagccatccgccgcgtgatggcggagctggagcaaggcgcgttgtcgcttgccgccggccggctgaccctggtgccggtggccaacccgctggcttaccagctgggccggcgcggcggcgagcgcaatctgaaccgcaacctcgccccggcagcctcgccgcaggactacgaggaccatgtcgccaactggctgtgcccgttgctggccgagcacgacgcgctgctcgacctgcattccttccaatcccccggccaacccttcgtgtttctcgggccgcgcgacaacgccggcgagctggagccctttgtccacgccgccaaggaagaggcgctggcgcgccggctgggcgtgggccgcgccgtggacggctggctggccacctacgcgctgggcgtggcgcgccgccgccaggcgccggccggcgacccgcagttggccgcgctgggggccgacccgcgctatggcgtgggcaccaccgaatacatgcgctcgcaaggcggctgggcgctgacgctggaatgcggccagcacgccgacccggccgcgccgcagatcgcctatcaggccattctcgacaccctggcgcacctgggcatgcgcgacgccgcgccgccgaccccgcgggcgcaagaatggctgagcctgtacgaggtggtggacaagctggacgacggcgaccgcttcgcccgcgcctgggccagcttcgacccggtggagcgggacgaattgataggctggcgcgccgacggcagcccggtgcgcgcccaagcccctggccgcatcgtgtttcccagccccggcgcgccggtcggccaggaatggttctacctggctcgcccctcgtcccggctatcggcgccggccgcctgagcggggcacggcggcgcaagaaagcccgcgccgtgatcaacggggcggaccgggctgcgcggaccagcctgacggcttagtcctggtcctggcgcacgtccagcagctcctgcagctggctgagcgtgccgctgtccttcaccacatgctgcagccactcctccaggctcatctcggcccagcgcgcggcgcgctccgccagcagcgaaaccgggctgtgcggctcgttgtggcggaaatagcgcgccacctcgcccagcatgcgcacggcttcgtcgcggctgcggatctggccatcaaacgcgctggcgggggcggcggtgtacaccgggctgggggcggcgtggctcacggttcggctttcctctgcggcgggctgcggctgcggggccgcggccggcttgttgacggcaaactgctggcgatagcgcagcaccaggtcctggcaggcgtagatggcgttgcggatgtcggccaggctgggcgcggcggcgccgaagcgcagatccacctgggcgtccagcgcctcgtaggcggtcagcgcgctgaccagctcctcggccttggcctgaaaccagccgtggccggactgggtggcggccttttcaaacacctcgccgctgagtttgccttcggcgatggcggcctcgcgggcgtagctgtccttcaagcccaggttttccacctcgcgcgactgctgccactggttccagctgtaggcgccgaactccggcttgatcaacggcacattgcgcagcgcgccgcccagctgctggttcagccactccagcttggccacccgttcgtccagatcctgcgggtccagctccggaaaaccgttttcccaatagcgttccagccagccggcggccagcgccaggccgcgcgccaggccggccacgccgttggcctgcacctgcgcctcggcgtaccaggccaccagttgcagatccttgctcttgttccgcagcgcgtcttcgcacagccggatcgccagcggccattccgccgttttcagcgtctgctcccagtcgccctgcgacagcgacggatcgtcgctgcggcgcgcttcgcggatctggtcgaaagtggcggaataggccaggtcttcgccggccggagcgccgccgcctatcggctgcagcaagtgttcgatttcgtgttccatgactctgtctttgttatgcggggctgcgccccaatgccggctagcccttgctgacttgcggcagggtggaaatcagggtggcgccgcagctgaccttgtggccatccagcgccaccgccttgccgcccaccagccagccgccgtcgccttcgacgatggtgcagttgacgtggccctgctgcgggcagctgacggagtcgccgacgcaagccacctgcttgccgaacagcgtggtggacgaggcggcgctcaccaccttgccgccgtggtcggtggggtcgcccaaacggattgccgctttcattcgctaacctcctccaggggcggcctggccagcgccagcgacaccctgtcgtgttgaaactgggtaaggacggccggcgcctgcaggcgcgcgcagtggctggcagccacggccgccagcagcatcggcgtcgccgcgccggcgtcgccccattcgcgcaccacgttgctggcctcgtctatcgggtgcagctccacctcgtgccgcgacaacgcggtggcgatggccgccagcctgacaccgccgacgtcgatctgcccgctgttgtggcacagccaggccagggtggcggcctggccaccatccggcttggcctcttccgggctgaacggatagtccagcaaaccggcattgaccagcgcgttgtccagcaccggctgcagctggcgcgccagttgcagcgcccggtcctgcgacaggtcggccgagctggactgcgccatcaccgccagcagcggcaactgcgccaggctggcctggcggctggccggcaccgcgccccagcccgccgccggtccggaaaactccttctcccaatacggctggtaggggtcggcgccctcgtcctgccgcatctcctgcggcagcggcaggccatcgcgcaggaacagcatcgccaccgccgccatgcccggctcgccatgccaacggcggtgcgcctgcaaggctgggtcgacatcgccccaatcctcgtcatcgtcgcgctgcgccagcggcgcgtcggcggccagcaccaacaggcccggcagctccggatcttgctgcaatgcctgcagcacccggtcggcgatcggcccgctgcccggcaggaagcggcaatcgccggcgacatggcaatcggcccccagcgcgtcggccaccgcggcctgcttcaaggccttgacccggttcagctgctccacgccgggcaccagcggcatcgcttccaggtataacggcagccaggccgcgcccggcgcttcggcgtataggctggccagcagctcggccagatggggctccagcgcgtccagcgcttcgcccggctccacctcgtccttggccagcgccagccagtagctgccgtcggcggtctcggccagccaggccggctcgtccttggccagcaccgcggcggcccacagccagcggcaactcaccgcgcgctggcgctcccgcagcgccgcctcatgctgggcgcgcgccgctgcgcgcttgccgtcgcgctcgctctgcgccgcctcctcctgccgcagcgcttcggccttggcccgcgtttccttcagatgcgcccacagcttgatgccgacgctgagcagcatcggcggcgccaggtgcagcatcaggatggcggacgggctgatgcgctgccagctcaccggcagcaccagccacagcaaagcccaccaacccagggtgatgccgccgaacaggcccaacattctccacatgtggataactccttagctcaagcgcactttcacctgctcgcccttcagcgagacggcgattttcttcaccgcacggccgcttgccatccgcgccagcaggtcgttggaaatctgcgccagcagcgtgcgggtgaggatggcgtcggcgttgcgcgcgccgctgtccacatccaggcagcgcgacgccatctgctcggccagatcggccgggaactcgacctgcgcgccgtggttgtcggcgatgcgctggcggatcttctccagcttcaggccgacgatggcgcgcagcacctcgtcgccgatagggaaataaggaacgatggtcaggcggccgaggaaagccggcttgaacgccttctgcagcgtcggccgcaggatttccaccaggtcttccgccgtcgggtcgcggttgacatcctccaccgtcacgccgtgctcgcaggcgcgcatcaccagatcggtgccggcgttggaagtcagcaggatgatggtgttcttgaagtccacctcgcggccttcgctatcctccagcacgcccttgtcgaacacctggaagaacagctccagcacgtcagggtgggccttctccacctcgtccagcagcaccaccgaatacggcttgcggcgcaccgcctcggtcagcacgccgccctcgccgtaaccgacatagcccggcggcgagcccttcaggccggacacgctgtgcgcttcctggtattcggacatattgatggtgatcaggttgcgctcgccgccgtacagcgcctcggccagcgccagcgcggtttcggtcttgccgacgccggacgggcccaccagcatgaacacgcccttgggcttgcccgggtcctccaggccggccttggcgatctgcacccgctcggcgatttgctccagcgcgtggtcctggccgatgacgcgctcgcccagcagctgggccagcttctgcacctgctccagctcgttgctgaccatgcggcccagcgggatgccggtccagccggaaatcacgtcggcgatcacgctctcgtccacgcattcgaaagccagcggctggtgcttttgcagctcgcgcaattccttgcgcttggcctgcagcgggctgatcttcttgcccttggccggcttggcttcgtcctgggccgccttcaatgcgtcgatctcggcgatcagcttctgctgcgcctcccaggcctggtgcagcgcggccaggtcctgttccagctcggcgcgccgcgcctgcagctcggcgatgcgctcggcgtggccttcttcgcgctccagcgccgcggtttcgcggtcgatgttttcaatcagcaccgacacgtcctcgatcgggccgggcttgccggcgcgcgacagcgcgacgcgggcgcaggcggtgtcgagcacgctgatggccttgtccggcagttggcggccggcgatgtagcggctggacagatgcacggcggctgccaccgcctcgttgaggatttccacctggtggtggccggccatcgcgccggtcaggccgcgcaccatctgcacggcgatctccggcgccggctcttccaccttcaccacctggaagcggcgcgccagcgcggcgtccttctcgaagtatttcttgtattcggcccaggtcgtcgccgcgatggtgcgcagctcgccgcgcgccagcgccggcttcagcagattggccgcgtcgttctggccggccgcgccgccggcgccgatcagggtgtgcgcctcgtcgatgaacagaatgatcggcaccgggctggccttgacctcgtctatcacctggcgcaggcggttctcgaactcgcccttgacgctggcgccggcctgcagcaggcccaggtccagcgtgcgcaacgtcacgccggccagcaccggcggcacttcgcccagcacgatcttgcgcgccaggccttccaccaccgcggtcttgcccacgccgggctcgccggtgaggatggggttgttctgccggcggcgcatcaggatgtctatcatctggcggatttcgacgtcgcggcccaggatggggtcgatcttgccggcgcgcgcctgcgcggtcagatcgatggtgtacttgtccagcgccgggctgccgcgcttgccttgcggcgcggccggctgctcgccggcatccgcgtcatccgccgcctcaggctgcgcgccgccgttgcccgtttcgccgccgtgctggcgcagcgccgcgtaagcgccctgcagcctgccggcatcctggcgcgccagcgccggcgcgccggattgcagcgcgccgcgcaaggcgtcgtcctgccacagcgccagcagcaggtccagcgtggagacattgtcctggccatgctcggcgctggccagcaaccaggccttctccagccacttgggcagccaggacgacaacaccggattgcgggtgttgccgctgcggaaattgtccagcgcggcgtccagctcgcgctcgacgcgggccagatcggcgcccagcgcgcgcaaggccgccagcgcggcgttgtcgtcctgatcgaacatcgccagcagcgcatgctcgatctcgatctcgaagtgggtgcgggccagcgcgcggctggcggcctgctcgatggcctggcgcgcggtcggcgtcagtcggcctatcagggatttcagcgatacggacataggcttgtactcgtcttctaaaggtatggattcaaatcattcgtcgttggcggctgcggccggcatcatctcgcccagccagcctcgcagcgccgcgcatccgttttcgtccaggtcggccagcatcggcgcgtaccagttgagcagcgcctggtcatccaagcattgccgcagcaagggccagctgttctccaggaagaccgggaaaaacggcacgccgcgctgctgcaaaaactgatcgtcggtgatcctcagctggcggtacagctcgcgcagccaggcgaggtagggcagcgtttcgcgcgcatggccggcttgagccagcgccgcgatgaaattgacataagccgccgcgcacggcacctcgcggctggcgtggttcagttcatcgaacttcatcaaccaggccttgccccgcgccacctcgccggccatcaccgaacaactggccaattgcaacgcattgcgggctgacggctccagctcgaacagcttctgccagcaggaaagcgccgtgctccactgcatctgccggctgctggccagcgcgcacaagcggtaggcgtcggcgcgcaagctggcggacttcgcctccaggtggggctgcgccagcttcaacgcctgctgccattcctcgcgttgcagcgcgtccagcgcggcgcgcagctgcggcggcgcatcctgcggctcggccagttggatgggcatcgctttgcggcccaggatgcgcgacagaatgctcatggcgtttctttccgatcaggacaacagggtgtaacgcatatcgtcgggatggcccgccggcttgcccaaccagccatcgccgcccaggcgcagcgacgcgtcgcccagcaccgccgccgcgacgtcgcgcttgtccagcaccaggcatacctccaccgccagcgcgtggccgagcgcgaacttcatcagcgcgcgcagcgcctgcgcgccggcggcgtgcggctgcagcgcgtcgaactgcgcgcgccgcaacggccccagccgcagcttgagtttggtttgcctatcccagatgcgctcgccggcaaaggcggaaaaacccagctcgcagccttccattcccagctggctctgctcggcgcgcggcaccggcagccattggccgacgaactgctccaggctggccgtcacgccgaagaagccctccaccaacgtggtcaaggcttgcgccgacatcggcttttggctgagcaggccggcgtagtagacgaacatgcgctcgtccagctcggcgcccggccccatctgctggcgcagctggcccaggcccactccgcccaggtccagcagattgcgggtgaagccgtcgcgctcgccggcttcgacattcacccagctgcggtatttgcaccaggcttcgaagaacagcgcgccggcgcggtggctgaacagatcgaagaaagcatgcatggtgctgtcgcggtggcgcagcttgcgctccagcagcagctcggtataggcggtgggcaaggctccgctcggcccggtcaggccgaggaagctgatggtcatctcgtcctggccgccgctgcccgcttccgcctggcggtaagttgtcagctcgctggccgggaacgacaaggaggccagcgtgcggaaacgcagcgcatccggcaaacggccgcgcttggcgccgcgcttgcgcccggccagccccagcaggcgcactgcctggaagaagccgaactggctggcgtcggcggccagctcgcgcgtcagatcacgagggcttcgccggctcgggctggccataccgccacctcctcgttttgttgcacggtttccacccgcagccgggtgaagctgttgggcgcgcagtacagcgcgaagaaacgctccaggatcgacgcgaacaggtaaacgctgccgccgacataataatcggcgtcaagtttcaggcggatttcactgccgcgcacgaagccggcgaaatcgcggccgctgacgcgggtgaccgccgcctcgctgtgaatgcctactatgccctggatttgccgcacgttcaccggagaagcggtgagattgtacagcgccagcatttcctgcagggcggcgcagccggagtcgacgatggacatgtaattcagcgacaggtgcgagatcagccgccactgcacggcgcggcccagcgggctgcgctggctggcggacggcttgcgcagcagcctcacccgcttcaccaccgaatggcccggcagcgaaaaatcggtgcgctgggtggactggctgccgccgaacggaatctgctccggcaaatcgcggttgctgcacagcaggtccaggctcagcacctcggccgccgggcgcaccatattgaacgccaggtccaccaggtgcagctccaggtcggtgcccttgtcgccggcgcgcggcgagccctcgcggctggcgtgccagtagaagcgcggcgcctgcttttcgctgccgtggcgggtggcgtagaacggcggcacctcctcgctgctttcgccctcgcccgatttctccacccgcaccacgcggcggatctggatcgcctcgtaggccagcggcttgcgcgaatccgccagcaccgcgtagccggccttctggtggctgacgcggatgggctcggccgggtggttgaacagattgacgatgggcgcgcagcccagcttcagatgatgggcctgcaactgcgcctgcagccggtggtggcgctcgctgtccggatagtcggccagcaccagttgcagcaccagcttctcccctgtcagccgcggcgccgccttggccagttcgccgatatcgacgaacaggaatttttccgggtagcagaagtattcggtcagcagccggtagcccatgaacgagcgctcgtcatactccagcatgccctcgtcgcggccgaagcccaccgggaggatggccgaggccggcagcagcgcgctgtgcgccggatcctcgctgccgtcgccgacgcggatgcgcagcaccttggacagcagcagttcgtacagcagatgcatcagcgccggttcgccgtccaggaagaaacgcaacgactccaggccgatgtcgctcaccgccaggccgccgtgggtgtggaactccagcgtcaacagcgccgccgcgtccggcgccagctggcgcaaatagggcgagccgctggtcaactccagcttggcgttttccagcgacagcgggtacaggtccaccgggtaggcgctgcggaatttgcacaccacgccgccgatggccggcgcatgcactggctggccgcgctccacgcggtagcgcttggcgatctccggccgcgccggatcgcactcgaactgcacgatggtggccgacggaatcggctgcagatagtgcgggtagagcacgtcgaggaagctttccgccacctccgggtattcatcgtccagcttcttgtggacgcgcgaagccagcagcgcgaacgcctcgatcagccgctcggtgtgcgggtcggcgcactggtcgccttccatctgcagccggccggctatcttcggatagcggcgcgcgaattcgccggacagctcgcgcaggtggccgagctcgcgttcgtagtaggggagtaaggattcgagcatatgatttctatattgtattgacttgtgaacctacaagcctatccgtggcaatgcaacaacttcatactcacaagccgccaaactaaattacatctcttccttcgcaacaatccttttcgaatcagtcactcgctatcaaaatttactctttatcttttccatccgtactaaagagtgcgaaacaagcgagcttcagtcacatcttccgcagcactatccatatgcagctatttttcatcctattgcagcgccaccacgcacttactattaaatcccaaccctgcaatcccttcatacaacctgcactcattggctttcccgccatacagcagacaacctcacctgggttccgaaggctctatttcgcttatttcatagacgtactggtcatccaccacaagcttgtaatccgcatcgtaaaaaagaccatgcgcttcataatcagtaaagcgaataatcaaagtgggtgcggcactctctggtggagaaaatatatgcaaattaaacttgctgctaatctgaatcggatccaagaaaccaccacctttttcatatcgatacaaaacaactcgatgaggcagcactcctttccagccgacaacattcacattattgccaaagtatttacaagattccgcatgagcatgccccaataaaaaagtgattgaaactactaaaacatggctagcaaatttcaacatactcacagcgattactttcgaagaaaattaaaacatcaacaacaatgacaatttcgctcttcaccgcagaatacccgattaagccctaaaatctgaaaagactataattcaggataagtctgcgaagttcaacactcaccaaaacacaatgcaatcaatacctgagatccgtgagttatattcataaaacaactccacgctggacacacccatccaaactactacttacaaaccgacaccaacaccgcgccttactccttaatcatctccgcacattcccgattaaaagctatcccttcaccgccgaatattgttttacagctattcactcttccccctccaagctgacatcccaacgacactcttgttttttctaatttcgagattttaaattgatacccttctcccagtatcagtttataatctgcatcaacaggtaaatttttttcaccataatcagaaaattttacaattaaagtaggtgctttgttttcctttggccaccaaatatcggctcgataagtctccttactgacctgaacaggattaataaaatttccatttgcctgatagcgatataacactgccttcttcggcacctttcccgtccaatgctgaatggaaaaattatttaccaaaatttcacactcactagcctcagcgcaacaagacatcaacaggctgccacagcaaaatatcatacatctagaaagactcaaatcatagcctttctggccttaccttctggctcaccattctttggaccatcatgcagcggtgtcagcaaagttattttgcgcggcactttgataacagccacatgaaatttgccagaattagaataattaataaccaattaagtccttctcgcagtagtgccgcccattaattcattcgtttatggcttactgatgctaagcatctcgcttttaactcttctttcttctagcggacatgcgaagccagcagcgccagcgccctgatcagccacttggcatgcagatctgcgcactggtcgccttccatctgcagcggctggctatcttcggataacggcgcaaaaattcgcaagacagctcgcgcaggtggccgagttcgcgttcgtaataggagagtaaggattccagcatatttcaatcatcggtttggctcttggcgcgatacggatgttccagtcaatgaattcattcgcggcaagctcatcgctgagtaaaagccttcacctgctccctgcgctccaactctttcttgaacgcctcattggcttcatccgattcgcagatcagcttcttgttatcgtcgtgaacaaagaaaaccgtgcgataacgccagtacgaaccattcggttctaatttgctcagagccgaatacatgaaccaggcgcgcgagtcatgcacatgttcatcatatagcgccatcaattccgcattatctttcacatccgggtagagtttttcgctcttgtcgatcaacaaagcccgctccttgccggtgcaatctttgctgaacattcgcgagacggccgtaaacatggtcgccaaccatccaaccgggttaaatcccacgctaatttttccctggtagtcatcgctgaaatctttggcccccgcctgcaactgggtgccgtcccgcgtcggctcatatactttggacaaattgggggtgaatggcttgccgatataggccttgtccatatcgctcagtttgtcctccgggataggcacatcaacaaagcgtctctcctgcgcggatggaagcttccaggtcggcggcgtcatatgcacctcatcggctctacccgtgctgctttgcttgctccaagccgcgttttcctgatcaatggcccaggatggcgtttcccgtttcgcctgcgcgtatttgaaataatcggcgttctgctggccctgcccaccttggcatttcagcccgcccgcgtagcgctcgatgcgccaggcgttgatctgggcggtttgctcctgcaggatggccgtcagcgagccggaagctttggaggcttcgcgccaagcattgaatctaacctcaagtaatggttttgtactaaacaggccgataacttcctgactcataaagcgccacgactcctgcttctgcagcaccgccagtttggccttgtccgcggcggcgccttcctgcaatacagcggcattgatcttcaagggcgcgcctgcatcaaacgccagcctgtacatatgattcaaaggcagctgcgacaacagcaggccctgctctccacgcgccttgccctgatcattgggcggataaccgccgccgacatcgctatgcatgccgggatacacccattcaccctggacgcagcttgggtagccgccggaggcgctattgcccacggagtccaacggaaagcacaaccgctgctcatgggcgctgaccatgtgcgcgcagcacagcaaccaggctttgtcaggcagcgccatgtcgccaccccagtccaagtggccggtggcacccggtgctagctcggtcaagcccaccgaggccacggtatcgaatatcccgagaaatttcacttccaacgggatgccgaaaaacgtcccgtccggcatctgttcgttcagccgccacaaaaaggctcgcgcctcggccgccccgcgcgagaaaccgtaaacgcacagcttgatcttcagcagctgcggtttgaagtccggctgggccagcttgttcaggactttggtcatgccctccttcatggcggcttgacgatctgacaggctggtgggttttttcaccttcaggccgttttccacctcctcataggtgaattccattctctggataacatccaaggctttgtcatcatcatactttccgatacccatcgctttttgcagcgaatcgatcaaccgggtcaagccccataaaatacgccgctccccccctgtggcaaaactcaagccagatgaggaaggagcattctccttgatttctacaaatgtagttcccacaccctgcatgtagtgcttaaaatatccactactttcagattcgtcattaccaagcgaggcacgatataagcgtcgcacattgctgctacacacagaactagccttgtcatcggaatcaccatgattattggtgccatcaaaaaacaggctgatattgagcaccaaactacatggaaccggcttgccagcagcacgctcatccatgcaatgagccgatatctccgattgctgagagagccgctgcgaaatgacatcggaaattgaaaccgggaagtatcctttttcaggaaaagcaggtgccaagcttaatggcatgtctgctttcctcctaatcgacgaattaactctggatatctgccaggtcctcctggcaaagtattcataatctcgaggtcttgatcacaatcaataattacccttggatcgtcgcatggcaaaaatatcaatgacacgccacatgttctatcatacctaggcacatttactatcttgctcagggtctggtaattagacctatgaatacgcatccattcatcccattctggcgtggagtgaccattcttccattttggcggcggtacattcccaggattcaactcaggactaggatcttttttccaggtaatttcggccatcatcccaggcctccatttctttgggatgctgatgcagcactcatctcccccctcaccactcacaccttgcccattaaatgtagcgcgaataatgctgacgcttttatcagcgttgacaacacgagccggaacacctttcatctcttcaccggccaggctttggcagccagacatcaaagccaacatcgataaaatcaaggcggacaaccattttttttgcattgcatttctccaaaatctgcttgacaactgccatagtacttactgacaggtctgtttgccatccatgcgaccggtcaactcttggtatcggtttgtccctgctggcaacgttaccccgcatgtctcatcatatttcggcacaggcaccattgctttcatgacaaacgcattgagctttgtgaacggccttccaagttttctccgcatcagacaaggaggtgttcggattagacttcggccttttagaaccatcaggattacgttcaatatccggatccttcatccactcaaccttcgcgatcatgcccggctgccacttggcgggaaactcgacacagcgatcatcgccacctccaccatcaatgctctggccattaaattttgcccagagaatactcgtattgggcacagtgttgattgtccgtcctgagccgcccatcattttaggctcgcccatgccctgacagcccgccagaccgatcaaggcgccgcccccagagcaagcgccgccaattcatgcgtgttccctgagcatgcgttccacttccggcatccgctccgcctcggaccacagcttggccttgtccgccgcctggtgggccagcgccagccggcgcaccagttcctcttcggaatccaggccatacaactgcggcaccaacaggtggttttgccgccagatttccgccaaatgccagcaagccagcgcgtcgatatgtggcggctccagcgtcagcgcgtcatgcttccactccagcggcgccagcgcctgcagcgcggtggcgtccaacatccgcgcgtggccatcacggtccagccagtgccattgcagcgccggctccagcagcaactggcggcgcggttcgtccaatgcgtcaaccacagcggcaaacagccgcgggtcgtggaagcgcagcacgccttgctgcaagcccttgtcccaggaggcctgcatgcatagcgtcagccgttcggccagttggtcgtagtcccacccgctgaacagcgccagcacccgcggctgtccctgccattgccgcagcagtttcagcaagcgcgtttgcggctgattggcgtccaggcgcaccaaaaccgggccttcgtcggctgcgtcggcatgcggggtgtcctgcagcagcatgcgcggcgggtacagggtgcctaccaggctttgccagcgcgatcccatctcggcctgatcgactatcaagtccagccatggcagctcgagctctcgtgccgtctgcaatagcctgtacagccaggcttccgggcttggggcggtcatcacgatttgcggcttcatttggcggccaccagcggattagcctggctgaacccctgagccatgcattgcttgcacaccgtattggggaagcgcggcagcggcggattcatctggtccggcccgctccaatcatggctggcccccttgatgctgacggtgcccggcgcatgcagctcgatcttgccgtccttgatccgcacataggcaccgccgctggtcagcaagatttcctgtttgccgttgaggtggatcttctgtttcaccgaggtgatggagaggtcttgatccgccgtcagctccatcgcatcgctctgcgcctgcacttgcaccttccccttcgccgcgatcagcttcagcgccaccttgtccttcacccccgccacgaacaggctgaggtgctggccgacgttgtggatccaacgccggcccgtcgtgtggttggcgtcgcgttgggcgaccaggttgaggttctggccggccgatatcgtctggctctgctcggtcagggcggcgatgccggccgggccggacagcaccagcagcggctgttggccggcttggtcctgggcggttttgccgtctttgtcggtgttgctgccggcttcccaggccttcagcgcgtcggcgtggtgttgcaggtggccttgggatttcttgccggttttggcgttgtccgcgctgatttcgtcggggccggtttccatgctgtcggccagttggccggtggcggtttcgccaggcgctggccgaaaccgccaccggccaactggccgacagcatggaaaccggccccgacgaaatcagcgcggacaacgccaaaaccggcaagaaatcccaaggccacctgcaacaccacgccgacgcgctgaaggcctgggaagccncaccatcctgcacgacttctgaggaggacgccgcatgagctgcccctacgaccgctggctgcccgatcagccggcaccaatgcccgaccagggcgaggagtgaaaaaatgactcctcgccctggtcgggcattggtgccggctgatcgggcagccagcggtcgtaggggcagctcatgcggcgtcctcctcagaagtcgtgcaggatggtgaatgctgctgcagccactcgcggaacctggccgttcccaagggatttaagtcggtccaccctatgggccaccccattagccactcgacccagtcggggttcagctggccacccacagattggggcaggttctccccttgtttgccgccggttcgatccaggcaggatcgacctggggagcgatagtcccgcctgaccggagttggccagagctgggttgcttggtgcaatgacagccccctcttgcccctggctatgcacccttttcctccggcctgccgcgagtcctgggcggtcggcgtgggccagaccatcacctgggccgacagcttcggctcgccgcggctgttccacttcccggccgagcggttcactgcatcgtccgcaacgggcgtttgccacaagccagatgcggtcccgctgatggggcgctccaaggtcggatgccgcaagacaagcccactgcgcgtcataccccagcgcggcaaggtcaccgatgaccacggcaaggcctcgtcccacaagcagcggtgagttctccacgaggacgtggctgggtcgtacctcgccgatgattcgggccatttcacgccagaggcctgagcgcgcgccgtcgatgcctgcgccggcgccggcggcgctgatgtcctggcacgggaatccgccagaaaccacgttaacaaggccgcgccatggccgtccgtcaaaggtgcgcacgtcatcccagatcgggaaatgcgggagaaggccgtcattctgtcgggctgcaagtacagccgcggcgtagggctcccattcgacggcgcaaacggtgttccatccgaggaggtggccgccaagaattcctccaccagcgcccgcgaaaagtgccaactcattcatgccatcctcaaaaagaaagaggcccgcgcgggcctcgtgtgttggtgctgggcttacagctcgcccccatcgctctccaccccgtcgtcggggtagcgcggctcatcggcctggccggccgccgccggcagcggctcaggccgcggcgtgacgtggtagtcctcgccgtaggtctggtagatcacgctgcctcccggtgccgcaggatgccgaaatacacctcgcggcagccggccacgtccaccatggcgttgtgcgcgccgagcagatcctggccagtgaagaacttgtaggcctccgccaaattcggcggcttcggcccggtgcgcttggcggccagcatcttctcggtcggcggcaggttgaccagtttggtgctgttcgagcaggtgcagaacgccgcgccggctttccattcgtcggcgcgctcgtcaccatacagccgcatcagctcgattcggatcatgcgagcgtcgaacggctcgttatgcccgatgcgccgctccacctgcgcccacagggccaggaacgaatccatcgcctgcgccagcggcacgccgaattctgcggcccgctcggtggtaatgccggtcagcgccgccacgtcgtcgggtatcgtccagccatccggctggatcagcatgtccatgctgtccagcacgtcgccggtgtcctcgtccaccagttcggcggccagctgggtgatgtgcggctgcgacgggtcgtcagatggtgcgctccagttcggcaggccggtggtttcggtgtcgtagaaaaggatgggtttcatggggttttccttggtttttgggtggtggattacgccgcttgcgggatggtttcggagacgaccacctcgccgcccttgatccagacggactggataacctcatcgcctgccggcggcgacttcagggtgccgaacacgagggcggtgtcgagttcgtcgtccagcgcctccagcagatccaacaattcgccgcggccggcgatagacagcacatcgaaccggtccagcagcaccagccgcaggccgctcatgatcgacagcgccagcgcgatgatgcagtcgacgcgccatttctcggactcggacagcagtccataggcgcggctgtcggcgctgattgacatgtcgttggcgatgagcggccgcgcccagccggccaagcgcgccagctcgaacaaccggtcattcaccgggcgcagcgcgtcggccaggatctcgcccgggatgccatccggcgccatggcgtcggcgatcagcgtccaggcctgcacgtcggcgtggtgctgggcggcctgccgggtgcgctggacagcgtcagccgcgacgcggttctgctcctgcagggtggccagggtgtcggccaactggcggtggctggcctgcagcgtggtgatgcgttcgaccagggccgcgacctctgcgtccgtcaccggcgccaattgctcggcaccatgcagcgcctgcagttgggcggcggcgtccgcggcgatcttcaggtcacgctcatcgttggcgacggcgcggctcatcatgtccagcgagtgctggagctgcggcaggcgcgccatatcttcggcgctcggcggcacgccgtcgtctgccaggctgccatgctcggcggcgtactggtccagcgcggcattggccgttttcaggtgctggcgctgctccgggttcatctgccccagcgggatcgccatcgtcagagacagattcagcgcgcgcgccaggtcgtggaccagcccaacgcgcggcgccgggccggcggtgatagcctccacctcgtcgcggacgcgcgccagctccaccagatccaccttcaagcgagtctggatgcgctctagcggtgccgcggctgcggtcagcccggtcagctggcgctggcggtcgtcctgctgctgccggcgggcgcgcagttcgcccagccgctgctggcattgggcaatctcgtcctgcaccgcctgggcgtcctgctgggcctgctgaatatcgccgtcctgcaccgcctgggcgtcctgctgccatccctcagccttcttgtcgccgtaggtttcgccggtcagcgcgcgccacgcgccgcgggcctcggtggcgcgggcctgggcgtccttcagcgccgccgggaaaccggacagcaccagcggcatgatggcgtcgatgtggcgctgctcggcgccgcgcttcttcagccgcttttccacttcggcggcgttggcgttgcaaccggtcagcgcgtacagcagcgcgcggcgggaatccgtcggcgcggccgcgaacatctccggggccagcacgtagggcagcgtgtcctgggccgtgtcgttgtcgatcgcgatgccggcggttttaccgtctggcagcgacaccgcggcatggcggccgtcgtcaaagtcgacccgcacgccgctgttcttggccccctcgctcaccaactggccgaaatccttcttgcgctccacgcgggtggccacgccggtcagcgccatggcaatggcgtcgcgcagcgagcttttgccggcgccgttgtcgccggcgatcagcgcgatgcggctggaaaaggaaagggccgcattacgcagcccctggaaattcttgatggtgatggatgagattttcatgctgccttgctcctttctttggcgcggtcggcgctcatgcgttcagcgcggcgattctcgcgcgcgaccagcgcggtgttctgatcggccaaatccttggcacttttcagaaccgtatccagttgctggtccttcatttcgatcaggatgcgcatctgctcgatctggccgtcccgctcggccacagcctgggccagcgtggcgatttccatcgcatagcgcatggtggtgatgtggttgctcacgatgctctccgacgggcgcgtgcggcgccctggtgatgggtgatgggttatgcggcttctggctcgtcgtcgacggccagctcttccagcgtgccgccggcatccagccacgcctgcacccaggccggcttgcggccgcggccggtccaggtctggttttcgttcgtggggtggcggtagcggacagctggctgcgtgatctttcgttccagctcgggctccggctcgggctgcttgtcggtgaacagctcagcgccagcggcgtcttccttggcggccttccagcccttcacccactcgatgcacagcgcgccggccatcaccgggcacgcactctccggctcgcccgcctcggcggcgtcatacccggcgtcgaacgccgcatcgagttccgcctccgtcggcgtggcgtctcccggcgccggcaactgcttcacctcctcgaactcggcatcgaccacgttgccgtcctggacgtcgtccatgccgccgccgtcgttgttgtggtactcgtggcccaggtccagcgcgcgctggtcggtctcgccgtggatgtcgtccatgccggccaggttctcgccagcgtctgcgatgatgatcaggcacgccttgcgctcgctgtcgaacagctcatgccggccttcggcgttgctgttgatcttgaacacagccttgatgccgtccttgcggaccacctgatccagttcgccgaccaccgtggtccggccctcgctggccaggacatgcaccgccatgcggatgttggtttccacgcgggctcgaatgcggtcgatcacatcgtcctgcttctgctgcggcagcttctgccacacgtccggcatcagcttgatttcctggagcagcgcgcccaacaggtctttgccgatgctgtcggcggtcatggcgcgaaaatcgcggggtgcgttcattggttggtcctttcaaaaattggcggcgatgcgttcgaggtggtggcgctggagagcgctgatatgcatgcccatgccgtacaggcgcaggcgctcttgcatggagtcgatgaaattgcggtcccaatcgctgctggcattggtttccgcatccgatagcagttccttcagccggtcgggcgtgtagatcgagctggccggccgcgtagcgatgacgcggcccatgccctactccagatcgcgctggcgccgctggcgcgccgcgggctgctgctcgttggcgatggtctgctcgatgatctgctggtccttctcggacagactgcgagccatgtcgcgggcgtcgtccaggttgccggcgcgcacggcggccaacgcatcctgcaggccgaacatcggctgcgcctccgcgcgctgctgcgactcctcggcctcggctgcctgataaaccggatccgcctggcgctggcgccggaactgctgctgcgtcagcacctcgccggtgtcggtatcgacgtcggccggcgcgcccagggcggcctgctgcccatcctcgcggccggcatcgtcctggccgatctgcggagcatcgtcgtccaccacactgaactcgccctgcagcacgttatccaggccctggcttgcgccatcgctggcgcggccatccagcgccgcagcggtggccagctcgatagataccggcaggtagttgaacagccggcgcagcaccgtcttgcggcccatctggacaaagtgctggccccacacgctgtcaccttccttgttccggcgcttggccgactgccagccctgcgaagcgttgcggatctcctcgatctgctcacggctcatcacctcgaaggcgtggccgccgccgaccagcttggcgaccgcgtagaaagcgatcacctcgccgcggttgctcatcgccggccggtgcaccagcttttcgtcaaggccatagctgtactcgaagaagtcgttctggcagacctcgtgcgcggaaatgctgatgatctggccggagcggcgcgccagatcgatcaggcccttgtagccgaagacgatctgcacctcggttttctccaccacccactgcccgtccaccttcttgtttttgtcgaacgggatcaggtaggcatggcccagcggcgtgttcggctccagtcccagctgcgaacactgcaccacggcgcccatcaggctctccacggtggcattcatcagcttgggcgtggtacgcagcgcgcccagggcgattttcagcatgcggtcggcgttgacgtgcttgggcaacacggcgaccagcgtggccttctggctttcgaagaaggttttcacactgccgataccggcctgtgccgccggcatcttcgaaacgcgcttcagctcggcgagattggttgctgctccggtcatggttggtcatccttgaatttgcacacgcgccaccgcgcgcagtatttggcgctgcaccggtggctggtggggttggggggaaacaggccgctgcggaacatgtccgccgcgtagtccatcaggccgggcgagtcgtccgagccaatcagctgctcgcgggcgccgacgatctggccgacggccacctccggcgcgccgctggttttcaggccgatgatgtcggccggcagcgtcaccgcctggccggtggtgcgctcgtacagcaactcgtaagtgccgatttgcggggcgtgccctttcgttttggctcgcccctggctgacggcgttgacgccgcttttcaggtcgcagatgcccacgccgccggtcccgtcagctcgcgcccggctccggtccagcgtgccgcgaatctcgatgacgatgccgccgccgcagtcgatcagccagggcaccacctccagctcgacggcgacatagtggtagcgcggcgcgatctccaggcagtagcgcgtcaccagctgcaggccgatccgctcggcgtcgcgccgggtcagctcgtcggcggaccagtcgacctcccggtcgggcgaggccaactcgtccaccagcaccggcgccacgtcgacgggccggatggcctggccggcgagcacggcctcgtcaaatgccgccgtggccgcatggatcgcggttcccagctgggcgcgcgggctgctgggcatccgcatgccgaggatgtgcgtgccctcccagcggtgggcgcagtcgaacaacgacgcccagctgctggcgcgcacgcggtagggttcagccatggccggactccactgcagcaatggcggccttggcgacatcattcagcgccagcagatgaatttctgcatcccgggcatccagacgggcttttttggtatcaccctcaagcaggcaatgcagatcagcccccgcttcattcgacaactccaagaccttccgcaatgccgccagcagctggtcgcgctggtgcgccaccgttgaatgccggctggcaggcaccagcccatgcgataccacggcgtcggacagtccggcgcacgcattcacgcaggccacgatgcggcgggcgttggcggcctgctgctccttggtgaactccaggcgcgcgcgctcatcgtcggacgggcaatcgatgcccagcttgtcggcgtagccgaggaggatggccgtctggcgcgcgtcgatgatgacgaaaccattctcgtcggtgatttccgcaccgctgtcggagtagtagccctcgtgcaggacgaggatcttgaatgtgtgttccatcacgccaccttcctctgcgctgccacatattcccgcagcttgcgtgccacgtagtcggcgcgggccgcctccagcatttccaccgtcagccggcgcgccgggcagtccggcatcttgtggacgaggtccagcagctgggcattcatcgccagcgtggcctcggtgctgccggcgacgtcctcccaatcgatcccgccgttggtgtacgcgacttgaaactcgcccgccttttccttcagatgatcggcctgacgctcagcgcggtcctgaatcatcaggtgttgccacaggctgccgacagcagcgcacggcatggtgtttgctctcatggtgttcagctcccaatcaggttgacggcggccagcagtacgacgatgccgacgcagaccgcgatggatttggcggccgccactaccgcgcggcgccgctcgatgcggttgatggtttgcagcaatggggacatgcggcctcccaggaaaaaagaagcccggcgcggggccgggcaaacggggtagtacgaggagaaggatgcgggtgcatccctgagcaccctgcgggcaagatgctcagggatgggccgcacacggcggcccggtgtatcagcgattcggtgcagggcctccgcttcagtgtgccgcctcgtgagaagcggccttctacaccacccgactccactcccttcatctgcatcttgcggccttgccgcttcccgctcgccctgcaggtttccatccccgcctggcgccgctggttgcatccgatcatgtgccggcgctatccgccctcttcgcccctggttgctgccaggtggtcacggtgggcggtgtgccgtctgctactgcggtttgttcaagatcgctccggcggtgtttgccggtggtgtgagcgaattattgcgatacgcaatcaacaatgtcaattgcgaaacgcaataaattttccgagtgttgcacgtaccgcaatagcggcacccgtgagcgccttctagggccgatgcggaatacataaaatgaaagctccaaacactggagctagagagatgaaagcaacaatgctggccatcctctgcctgggcgcgctatgcgggtgcgctacaccacaggagagacttaaagaagtgcgggacgccgccataaaaggctgcgaccccgaattggcagagctgctcgctgccagagcccgggcagcagcaagcctcgatcagatcacgaccgccctactggatgggcaaatacacgaccacgcaaacaacccaggcacgcaggagtgcatccaaaacgccatgaacatggaaatgcagatgcggacccagaacgcgatgctattcaacgcggccatgagacaaatgccgcagatgctgacgcggccgcagatagtccccacagcccccatgacggcgccggaaatgccagcgccaccagcgccaacacaaatcacctgcacccctcagacaggtacattcacgaccccatccatcatctgccagtaagccgccccgcggggcgcgatgccgcgccccgcgtcaacttgcagcattaccatccagctgtgcagcctttgctgaaactctctagcccagaatgcccggatgaacggaccaggcacaagaatcagggcagaacggatcgcattacacctgtcgcaggagaaactggcgcgccgggccggcgtcagccgcggcgtaatctcagacctcgaacgaggacgaagccgcggcaccacccacctactggccattgcgaagtcgctgaacgttagggcccaatggattgaaacgggcaaagagccgaagcgcccaacgccagcgcctgaaaacaccttcgtggccgccacctccatggaggacttggcagatcgacttctggaaatgggaccagatgccataggtcgactatggtcgttaatccttcaacgaaagattccagactgaaatagtcaactgacttaacgtgcaatgttgcattcaaaccaaaaaaaccaaatggaatttgcaacaaaagtgagcggtgcggctgctattgtaaagaatacgtataaatgcgtactatccgcacgtgtcagaaaattttcacgaccggctgcgggcagctatgcgcgcccgcggtgtcaaatctccatccgtcgccatcttcatgaacgtgagccggtttaccgtaggtcgctggtgcaaataccaaatgcctgaccacgaacagataagcaagcttgctgcatacctaaatgtcacgcccgcgcacctcctgcacggcgaccccatcgaccatgagcacattgaccgctgccaccatctctttgcccttgcaactggcctagagaccggggacgtagacgcgatgattcgcctcgcaacctcgattcttgctacaaaaatgtagcaaaagagtacagatggaaatctgtactgatacccctcccgcataatccgccgtaggctgtcctatgtcaggcgatccaagcccaaaaggccaagatcaccgagaacgaacaacaaaaaggggttcgcatggatggcaatacaacgggaacgatgggcggaaaaccgtgcattcacacggggaactgccaccacttcagacctatggattctggaataggtaatggagcaaccgccaactcaataggcacggaagacagcaagacactgccgccgccaggtggtgccggcttcatatttttcgcagtagacgaggaaggctgtatcaggatcgagcgagggggaaatcttgattcggtactgcaggcgctgggcgattacgtccgggaggtgaagcgcaagatatggtaactacgggcgcgtgaagctactgcttcacggcgcccttcagcgcttccaaaacatccgccagcttctgagtttcgccagccggcaattcatgaatcgcatccatgatcctaccgacaacaggattggcccgaacctcgataccataggccagccacgccgcatcaacacccagcgcaccagcgagggcatcgatatcttccaggttcggcacatttcgcccattaagccagcacgcaaaagtgctttgcgatcggtgcatccgatccgccacggctcgctgagtcagcttcttatcgcgcatcacctcgcgcgcacgctcttgccacgttttcatatcaaaaattctagcgttgcatagcatcatacgatgctgatgatttgcaatcattttcagcgccttcctttcttgattttgattgcgtaacgcaataaactccgctcatgaacaagctacgaaactggcgcgaacaacagcgcctgacccagaaagaagccgctgaccgatttggttccgaccaggcgagcgtgtcgctgtgggaatcaggtgctcgcggcattccaaaaagcaaactggaacgggtgcatcgagtgacccgtattccgctgcgtcagttgctgtccctaaagtctcaactatgacaaagctgtttacctgtaagtgcagtatggcatagcaagaagtgcccatttcgggacggtttgtcccgcttttaccctgaaaaggaggatttgatgaacgcaattacgcaggcagtcacatcaacccaggagcgaaaccatgtcaaggaaacgagctgatcgaaagaaccacgtcaagtccagcctgaccgaccgcacctacgacgccatgcagcgctatatggagctccacggcatcgataccgagtcggcggcggttgccaggatcttggatctggctctgctgggcatggtgggaagtattccggagatgctgatcgagcacactccgtccaacaacgggacgaaaaggattgcagcatgagccaagagcagaaacccgtagacgtgacgatggacatcgacatccccgctccggaagcggcggacctcgccggccgcgctgctgcgcatggcatatcgacccagcaatacctggggcttcacaccctaagaagcgcctacggcgtccttcaccctcgcgttgccgaactcgacaggctcgagagcgccgtcgaggaatagggctgcaaaaaacaaaacccccggtcgacggcctggccgggcctcgcgggggttcttctcaggtgatggagtgattatgcagaacgacatagcagatttcaacccgtcaaaaccctttatttccaaggcttccatggaacatccacgtaacgttacaagggggtcacatggccggaaatagatggtttcgcctatacgcggaattcgcatccgatccgaaggttcagatcctgccggaggcaatgcagcgccgtttggtgatgctgttttgcctgcgttgcagcaacgaccttgtaacgttacaagacgaagaaattgcgtttcagctccgtatcagcatcgatgacttggccgcaaccaaggctgtttttctggcaaagggtttcatcgatgaaggctggaacattgccaactggaaaaagcggcaattcgtctctgattcaagcgcagagcgggttgcacggcatcgggaaaagaagcggaaacagaagcaacagcccggtaacgttaccgcaacgccaccagatacagaaacagatacagataaacccacctctcttcgttcggtgggtgataccgcacgcacgaacaaccgcgacggcatccccgtccctgacgacttcacccccaatcgcacgatgcgcctgaaagccggcgagcttggtatcgacccggacgccgagaaggagcggttcatcctccaccaccaggccgcgacaacgctccgcgctgacgaaaccgcctggcagaagcaattcgggaaatggctgctggatcagcaccagatcaatgccgaccgcgagcgcatcacgcaatcgcggatgcaggccagccagagcaacaccggcaaccgccaggcggccatgtcctcgatgtacaacccaccgcgccgcgatatgcccgcagagcgtgagattcagggggaaacgatccatgagcaatgacctgatcaccggcgcaaccggaagcatccctctgcgctgggtggacgagattttccggcgcctgatggggcgatttggcgcgcagttcgccgacaaataccgcgacggccagcaagctaccgtcggcggcacaatcgtcgacgccggcatcgaagaggcgaagaaggtctgggccgaagagctggacattgccggcgccaccccgaaccagattgtgcgcggcctggcgcatcgctacacctacccgccgacctgcgacgagttcatccgcgcctgcatgggcgaaatcgccagcaacaaccgcgacccggaggttttgttctaccgcgcggtaacggagatgacgaagcgccgccggcacgagccgcaggactggccgagccagcccgtgttctgggcagcggtagccatgggcgatgatctgctgcgcggcgactacaaggctatggccggtcgatggcgcgccgccctggatgcaaaccgcgagcgcatggcggatatcccggatgtgagcccagatcacgccctgccggcgccgaagatgagccacgccgacgtgcaagtacacctcgccgacgtgcagcgcgcggcaaagcgcatgcggttcccggatgaagggcggatgcgtctggacaactggctcaagatcgccgacgaggtggcccgtggcgtctaccgtggcaccacgatcggcaagcagcatgccgccgccgcactgaaaaaagccggccacgcggtgcctgattcgctcatcccctatctgccggaatccacggagcaaagcacatgaaaaccgccctgcaactcgcctccctgctgttcacctggccgctgtgggtactcgccgttgtccagctgattgcccggcaacacgacgaggatatcgcatgaccccgcacgccaaagccgtcgtcactgtcctggccaccgcggccatcaccctgctcggcgccctggcgctgggcctgattcactgaggtaagccatgcaacacggactcaatttcgggcaaaggccgaatgccaaaaatcgcatgcaggcgctgggccggcttaaagcaggcgccatgaacaagaccgaggaggcttatgaaaatcacctcgcccaaaggaagcaggctggagaagtcgcgtggtatcggtttgagggcgtcaagttgcgcctcgcagacaacacgttctacagcccagatttcgccgtcatgctggcaaacggccagatggaaatgcacgaggtcaaggggcattggcaggacgatgcgcgcgccaagatcaagattgctgcggaccagtacccgttccgtttcatcgccgtgaaggtccaagcaaaacgggatggtggcggctgggcagtcgaagagttctgagcatcaacgcaacaagggggcaatatgcaggtacggcgcgaagatttcccacagcacctgtgggatgcaatggaggattggggctggttcgtgtcatggcgttccagccacggcggcagcagcacgtcgatcatcagcgctgaagggcgtatgcgccccaatcgctgcccggcctgctatgagttccccgacccgtgcgacgcgtgcaagcacgtcctgcagcccgcccgccaggtagacgccgacctgtgccagttcatcgaaggggcgtgggcggcgctgtccccggctatgccagagaaaaagctgctgcgcgggtattttgtccaccacgactcgccgcggtttctggttggccgcaccagcatccgccgcgatgatttctggtatctgctgatccgcgccgctcagcaggtctaccagcacgcccgcatggcccgctaccgctccgcttgcatgccggagaaatctgtcccagaatgcgagtgtcacagcagttcaagtgattcgaatgcgggagcttcgacaaagaacgagcggcgtaatgccgctcttgtcgtgcccgatcaataagcccagcacccgctgggcttttttcatttccgccctggtgcctcgaaaggaggtgatccgggcagctattcccaccctggaaactcccatggcacgaccgagcaaatacagccgcgccgtcgtggagcgtatctgcgagcgccttgcctgcggccatagcctgacccgaatctgccgcgatccgaagatgcccagcatgagcatggtgatgcggtggctcgacaagcacaccgagtttcgggagcaatacgcgcgcgccagggagatccaggccgacaccctggccgacgagatcctggacatcgccgacgacggccagaacgacacctaccccatcgatggcacgggcgcgaccggcgtaaaccacgacgtgatagcccgcagccggctgcgcgtggatgcccgcaagtggtacgcgagcaagctggcgccgaagaagtacggcgagatggtgaagcaagagataaccggcgccgatgacggccccctgatcgtggagattgtccgctatgccccggataagcctgccgaataactggaagcctcgcggctaccagctaggcatgtggggctatctggaacgcggcggcctgcgggcggtggaaatcgcgcatcggcgctggggcaaggacgaggtgtgcttgcactggactgccgtcgccgcccaccagcgcgtggccacgtactggcacatgctgccgcaggccagccaggctcgcaaagccatctgggaggcggtgaacccccacaccggccggcgccggatcgatgaggcattcccggtggaactgcgcgccaccacccgcgaacaggagatgatgatccggttccgcaacggcagcacctggcaggttgtgggctcggacaatttcaactcgctggtcggctcgccgccggccggcgtcgttttctccgagttcgcccttggaaacccggcggcgtgggcgtacttgcgcccgatcttggccgaaaacggtggctgggcgctgttcatcacgaccccgcgcggcaagaaccacgcctacaagctgctgcagactgcccaagcatccgcggactggtggggagaagtgcagaccgccgaagatactggcgtattcactgaggagcagctggccagcgaacgccgtgagcaagtggacctgttcggcgaagatgccggcgaggcgttctaccagcaggagtatttctgctcgttcgaggctgccgtcctcggtgcctactacggccgcgagttcgccacgatgcgccgagaaggccgcatcacgaaggtggcgcatgatccagcctttccggtgcattgcgctttcgacatcggctggagcgatgacacgtccatctggtggttccaggtgatcgccggagaggtgcggattctggagtcctacagcgagcacggccagaccgtcgccgacatcgttggtgagctcgcgggccgtgaatgcgaaatggacatcatcgccggagaggtcaagttccgattcagcgatgacatcgaggggctggagcatcgccgcgcctaccgctacggcacgctctggctaccgcatgacggcgccgccaaaacattcgccgccagcggcaagagcgtgcaggagcagctggccgcgcatttcggctggggcagcgtccgcatcgtgccgtccctatcgctgcaggatggcatccaggcaacgcgcgcgctgttgcggcggtgctggatggatgcagaccgctgcacagacggcatttccgccgctgaggcataccagcgcgagtacgacaccgagaatcgctgtttcaaggaagtccccctgcacaactggacgtcccacttgtctgacggtctgcgcatgctggccgtggcctggcgcgagccagtggaaaacgagcagcagaagccggcaccaaaattcttcgagcacatgaccgctgatgatctgttctggggcgacaccggcccagcgcaacgcaaacggatataacccccatgaccactgaaacccagattccggccgatccggaggctgcgcgctggatagcggaaatcaaccgctacgaggccaaggccggcccctggcatgagcgcggcaagcgcatcgtcaagcgctacaaggacgagcgagaaagcgagttggccaaaaccgccagccggtacaacgtcctgtggagcaacctgcaggtgatgctgccagcggtctacgcacgctgcccgaaaccggaagtggagcgccgctacaaggacgacgaccctgccggccgcgtagccagcgaggtgttggagcgctcactcgcgttcacccagcagctgaccgggttccatttcatcgtcaagaacgccgtgcgcgaccgcttcctgtgcggccgcggcgtggcatgggtgcgctacgtgcctcacctgcgcgatgccagcgtagagggagacgccgacgtccgagctgccggcgcccagctcaccgacgacgcgccagatggtgacgagtccgccggccagctggcgcatgtgccggatggcaccgagatggtcgactacgaagaggtgatgcccgattacgtgcattggacggacttcggccacaccggtgacgcccgcgtctgggaagaggtgacggccgtctggcgccgggtgtactgcacgcgcgccgagctggtgaaacggttcggcgaggaaatcggcaacgccgtgcctctgaccaaggcggccacgcctgacggcaaccagacggacagcgccacggtcccgcagaaagccatcgtttacgagatctgggacaagccgaccaggacagccatctgggtctgcaaggaccatccgcagaaggtgctggaccagcggcccgaccctctgaagttgaaccagttctggccgtgccctcgcccgctgttcgccacgctggcgggcgatacctgcatcccaacgccggactacgccatctaccaggaccaggcagaggagctggacggcctgacccagcgcatcaacgcactggtcaaggcggtcaagctggtgggcgtgtacgacggcagtgccgagggcgtcgagcggatgctgtcggagggggttgaaaaccggctggtgccggtcaagaactggccagcgttcgcagaaaagggcggcctagccggctcggtgcagttcctgccactggaacaggtggccgcagcgctgatgcagctgtacgaggcgcgcgagaaggtcaaacaggagatgtacgagatcaccggcatgtccgacatcctgcgcggcgccaacgacccaagcgagacggccacggccacccgcgccaaaggggcgttcgccagcatccggctgcgcgacatgcaggacgaggccgcccggttcgcccgcgacctgctggcgctgatgggcgaggtgatggcagcccatttcggcatggccaccctgctaacgatcagcggcgtggagttgctgccgcaggcgcagaaattgcagctccagcagatgcaacagcagccggccatgcctcaaggccacccccaagcaccgcagcagcctggccaaccgccgcagccggcaccagcgccagcccctcagctgtcgccgaaactgctgaaggcgatggccgaccccagcatcgaggaggtcgatgcgctgctcaagaacaacgcggcgcgaacgttccgcatcgacatcgagacggacagcaccatcggcgacgacgagcagcaggagcaacagcagcgcatggcgttcctggacagctgcagcaagttcctgcaggcggctgtgccggcggccgagcagaacccgaccatcgcgccgctgctgggcgagctgctgatgttcgccgtgcgctcgttcaaggtcggccgcagcctggagggcgcattccaggccacgttggacagactgcagcagctggccagccagccgcagccgccgaagcccgatccggagatgatcaaagtgcagggccggctgcaggaggtgcaggccaagggccaggtcgaaatgcagctggagcagatgcgcggccaagtttccatccaggtcgaacaggcaaagctggcggcgctgaaggatctggagcagttcaaggcccagctgcaggcccaggtcgacacgtccgcccaggccgcccaggcgcagcagaacgcgcaccagaacgcgctggaggctcagcgcgagatgatgcagcagcagttcgacgagaggatggagcagatgcggatggtgctggagcagcagcgcgccgaggccgaccagaatctgcagatcatcctggccaatctcaacaatgccgcgcgcgtggaggtggccgagattaccgcccagaccacgctgcagacggcccagatcagcgccgccgccgcagccgagcgcgcagacagcgcagaacccaacgggagcgacgagtaatgcccatctacgtcatgaagtgccagcactgccagcacaccctcgacatctaccggcgcgtcgccgagatgaacgacaacctgccggagtgctgcgggctggtgatggaacgccagatcaccgcgccattcatccagcccgaccagccggcctatcaggccatggccatcgacagcaaaaccggcaccgcgccgatgatcgagggccgcgcccagcaccgcgagttcctgcggcgaaacgactatgtagagctggggccggagagcagcaagccgaaaccgcgcaccgaggtgctgggcgacttcaacgtccggcgcgagttgaccgaggccacccgcgaggtgctggccaaacacaacgcctgaaagggaaaccatgaccgaaaccaccatcgagcagcaaatccaggccaaagggctgaccgcgccgcgcatcacgccggctgacgtcgaatccgccatcgccagcgagcactactttaccgccggccagggtgtggcaggtgccaccggcgtctaccccaatgacggccatccgggccagcccctggcgctgctgaccttctgcgtgctggtgctgaagaacggtttcaccgtcaccggcgagagcgcctgcgccagcccggagaacttcgacgctgagatcggccgcaagatcgctcgccagaatgcagtcaacaagctctggccgctgctgggcttccagctcaagcaaaagctgcacgacgccaaataaccccaatcccatcaagcaccagggccgccacgcgcggcccttcgtcatttctggagtcaaccaccatgagcgaacacgctactgcagtccccggcggcgaggaagagaacgacgccggcgaacagtccctgcgtgagcagctgcaggctgcctacaccgaacttaacagcgcgccgaatgacccgccgccgcagccgaagccggccgctgagcagcagaccaccggccagggcgagcccaagcccggcaccgccgcgcgcgatcaacagggccgcttcactgcgaagccggaaggcgcgcccgctgccgcagcagccgctgcccagtcggtggacaaaaccgccgtggccgcgcctgctgcagatgccagcgctgcgcaacccgcagccgctaccgcgccgccgccaagctggtccgccgaggcccgcccccattgggaaaaaatcccgccggaggcgcagcagtacatcgccacccgcgaagcccagatgcagcagcagttcagccgcatggacgacgagcgccagaccggccgccagttccgcgaggcgctgaagccgttcgaacacacgatccgccagttcaacgtgccgccggtggtggccgcccagcacctgttcgccgccgacgccgcgctgcgttacggcaacccggaccagaaaatccagatggtccaccagatcctgcgcgactacgccattccactggatgccgtggcgcagttccagccccagcaagttgaccctgccgtcgcagcgatgcagaagcgcctgcagcagctcgaacagatgcaactgcaaggggtacagcaacagcatgaagcccagcaggctgacatgcagcgccagatcgaggcgttccagcaaggcaaaccgcacttcgaacaggtgcgcggcgacatggccgtgcttctgcagtcggggatggcgagcagcctggatgatgcctacgaacgcgccgtatgggcacggcccgacctgcgccagaacctcatcagcaaacacgatgctgaccagagggaggcagcagcccaggccgccagccaacgagcccagcaggccaaagctgccggcgtcagcctcagcggcgcgcccggcagtgtcacccccgcagccgcaaaccagaacctcagcctgcgcgacgagttagcacaaagcctccgcgccgcccgcggccaggtctgaactgaaccgaatcgaaaggagcccacatgggactgcagaacccgtcggcaacgatgacggaaatcgtcaccaccacgctgcgcaaccgcagcgggaaaatcgccgacaacttcaccaagaacaacgccctcctctaccgcctgaagcgcaaaggcaaggtcaagccagtgtccggcggtcgcaccatcgtgcaagagctggaatacgccgagaacagcacttacaagcggtattcgggctatgagcagctgaacatcagcccgtccgacgtgttcaccggcgcggagttcaactacgcgcaggcggccgtggccatcagcatcagcggcctggaggagctgcagaacagcggcgaggagcaggttatcgacctgctggagggccggatctcgaacgccgaacgcaccatgaccaacaacgtggctctggactgctacagcgacggcaccgccgacggcggccgtcaaatcggcggcctgcagctgctggtcagccagaaccccgcgcagggcatggtgggcggtatcgacgcctccaccagcatcggcgcgttctggcgcaacctggcgttttccgcgttgcgcaacggtggcgcggccgtcaccccgcagaacatccaaggctacatgaaccagctgtggatcaacctgcttcgtggcgccgacaagaccgacctcatcgtcgccgacaacaactactacctggcctacctgtccagcctgcaggccatccaacgcatcacctcgtccgagatggccgaggccggcttcgagtccctgaagttcatgggcgccgacgtggtcccggatggtggcgtcggtggtggtgccccggcgaacagcatgtatttcctcaacacgaactacatcttcctgcggccgcacagcgcgagaaacttcgcgccgatcggcgataaccgctatgccaccaaccaagacgcgatggtcaagctcatcggctttgccggcaatatgacttgctcgaaccgtcgtctgcaaggcgtgctctgcgcgtaaggaaaggaacaacatggcacgttggactatgcaggacgccctgatcggcaccgtcgatctgggcagcgtcgacccggtcggcccggggccggaaatgctggtcggcccgaacgccggcaaaatgggccgctacaacctgccgtcgcagttcgtggacggcacccattcggtgctgggcggcggcttcttcgcgttcgcccaggttgcaccgatcgcggcccaggccgtgcaatccatcaccgtggcggccggggtagcaaccctgaccacgactgctccgcatggcctggccgtcggcgcggcgatctccatcgctggcgctcagccggcaggctacaacggccagttcatcgtcgcgtcggtgccgtctaccaccacgctgactttcaacgtcggcctggtgatcgacaccaacagccagcagccgattgccaacccgaacacgccgaccggcaacgcaactgtcgtcggctcgtacacggccggcatcggcgcgggccaggtggttcagttcacccacacgctggatggcaacggcaatctgatcctgcaggctcagccgtgggcgggggtgaaaaactccggcctgtctctgggcgcagcgatcagcaacccgcccgccggtcagtgggcgtggttccaggtaggtggcgccatgatcgtctacacctcgggcgcgcctgcggttggcggccaggcgtatttcggcgcggctggcagcgtgcagccgggcgcgtctgcctcgctgcagatgcagggcgtgcagtacgcgtcggcggccggcgccaccatcggcagcggcaacggccagatcgtgctgccggcaaaccaggcggtgctgtggggcaccttcccgctggcgcagggagccatcacctgatcgccaaacagggcggcttcggccgcccttctcttttcttggagcagccatgaacatcaccaccgaagaaatccgcctgatcgcgctggccttcgccgctaccaaccgccaccccgatccgcacgcccacgctgacgaagttgtggccgcgttcaatgaactggtgtcccacatccccggcggattcagccaagcgccggcggcgccggcatcgctgtatgccgcgccccagcaggaacacgccgagcccgccgcccagcagccctacatccccactttgaacaactgaccgtcagcccggcataacccacaaaggactaccccatgaacgacgcattcgccccggaaaaatacagtttttccccgggccaaaccatcgcgcaggtatcccatggcaacgataccggcctatacgtcgaattccacaccgaggccgtccatcagccgttcgagagccagcaagaagggcggccgattttcagcgaaatccctttcatcacgatcctgttccccggcgacaagaccaagaaggtggtccgccccgtcaagctgcaggacgatgaagccggtccttctgacctgcgccgcttcccgaaccaatgggccgccttcaaacaggagatgacgcagcacggcgacggtattccgctggagcagtggccgcagatcagtaaggtggaggtggccgagctgaaggcgctgaacatccacaccgtcgaccagttggcggcactcgcggacggcaatttgtcctggctcggtggccggcaactgcgcgaccgcgcccggacttggctggaagccgccgccggcaatgcgccgatggcgcgcatgcagtccgagctggaggcccgcgacaacaccatcacccggatggaacagtccatggctgccatgcaggctcagatagaagacctgcagaataagctgcaagagccgcgcaccgccgccgaagctgctgaaagcacctctcgcaggagccgcaacgcatgagcgcgctaactcccgccgggcacaaatccctgttgcagctgatacaggatgcgtgtgccgaaatcggcattatccagcctccccaggtgatcgggtccatcgaccccaccgtcaagcagcttttggcgctggcgaaccgcgaagggcaggaaatgcatgccatcgggaccagcattgacgggtggcagatgctccggcgggagttcgtgtggcaggtggtaggcggtcaggacacctacgcgttgccggcggacgctgacatgctcatccccggcacggcatgggaccgcagcatgcgctggcagctgctgggcccggcaacgccgcaggaatggcaggtgctgaagtccgcagtggtgccactggggccgcgccggcgctggcgtgtcctagccggccagtttgtgctgttcccggtccccagccccaccgacaacaacacgctggtctacgagtactacagcaactgctggtgccagtccgccaacaatgtgccgcaaccgcagttcgccgcggacacggacacctacctgctagacgacaacgtgatggtgttgggcatcatctggcgctaccgccggaaaaaggggctggagttcagcatcgaatacgaggactggaagcgcgcgcgcgatcgggcaatcgcctcccaggccggcatgcgcgatctgtcattgaccagcggttcaggcctgaaccccttcatctccacagcaaacatccccgataccgggtatggaaacataggctcctgacctcatggcatcgttttcgcccaccaccagcggcgtcagcgtgccggcgccggtaggcggctggaacgcgcgggacgccattgccaacatgccggccaacatggcctgcatcctgatcaacatgttccccactccatcggatgtggaaatcaggcctggattccagaactgggccaccgggctgccgggccaggttgacagcgtgttcgcctacaatgggccggccgcacgattgtttgccgcgtccagcgctggcatctacgacgtgacgaactccggcgccgtcggcgcgcccgcggtggccggccagtcatccgaccggtatgtcaccgcccacatgacgacaccaggcgggacgttcctttatgcagtgaatgggctggactacccccagttgtacaacggcagcagttggcagcaggtgacggccaccagctcgcccatcagcattaccggcatcccgctgaaccagatttcattcgtacatacggcaaaatcccggatctggttcgtgattggcggcacgcaggcggcctatttgcccgtgcagtcgctgggcggcgcggcacagattttcgacgtcggcccagtgttccgaaacggcggcaagctggtggcggttggaagctggagcgtcacgggcggtttcggcgcccaggatctgacggttttcgtctccaacaccggagaggtggcgatctaccagggcaccgacccatcgcagctcaccacatggtcgctggtcggggtctggcagttcggctcgccgatgggcaaccgctgcctgacgcggttcggcgatgacctgctctacctgagcaaggacgggctgcagagcatgaaccagggccggttcttcgccgacgtgagcgacaacaagtccgcgctgaccgacaacatccagtgggcaatcagcaacgccaccagcagttacccgaacaactacgggtggcaggccatcgcctaccctaccgccaacgcccttatcgtcaacgtgcccgtcagccagggtcagcagcaacagtatgtgcagaacaccgtcaccggcgcgtggtgccagttccagggatggaacgcgaatgcgttcgaggtgtttcacgaccagctgtacttcggtggcgccggcatcgttgcccaggcctggaaaggatggagcgacaacggcgcagcgatccaggcagaggcgctgccggcgttcagcaacttcggacagccggccacgctgaagaactggacatccgccaaacccattttttcgtcgtctggccagccgtccttcctgatgatgctgaacatcgactacgacaccacgccgccaatcggcatgatgtccacggcaccgatcaccatggccatgtggggatcggcgatatggggaacgtcgacctggccgtatgggcagaccatcatcaataactggcagtcggtaacgggtatgggctacaccgcggcgctgcacctgaaaatcaccacgaatggcgccaacgtgaagtggatggccacagattttgcattcgagatcgggagcgtgatgtgaagcggatcattttcgatgagcccgaacgcgtcgggcgctgggtctgcgaggcggccggcggccggtgggtggaggggaatccggccatcggcatggaggtcgacggccagctggtggtgggcgtcatgtacgacagttggacgggcagttccatcgccatccatagccggtgcgacgacccgcgcgcgctgaatcgtgagttctaccggcacattttcggctaccccttcaaccaactcggcgtgcgtcggctgaccggcctggtgggtgccagcaacatgcgggcgcgtcggctggatgaacggctcggcttccggcaagaggccacgctggccgactatttccccgatggcgacgccatcgtctacatcatgcggcgcgaggactgccgtttcctctgaggtttcccatgcgatacgaccacttcaccatgctgccggagcgtgcgttccggccggcaggcttcggcacgtccaagctcgccaccctggagggtggcggcaaaggtggctcagcgccggccgcgcctgatcctacggcgaccgcggccgcccagactaccagcaaccaacagacggccgcctacaatgcggcgctgaaccgcaccaacacctataccccgctcggaaacagcacctggacccagaacggcaccgaccccaccacgggcgcgccgatctggtcccaatccatcaacctgagccctggccagcagcatctgtacgactcgaacatgcagggttcgcagatgatgcagaacacctccaaccagctgttggggaatgtgggcagtcagctttctagcccggtgtctacgaatggcatgcctgccgtgcagtccagcgtcagcaccagcggcatgcctggctacgctgggccggtgaacggcggcgatctgaccggcctggcccagaacgcgacgaatgcgtcctacaacagccagatgtcgctgctgcagccgcagatggaccaggccaacaagtcgctggctgcccagctggcaaaccagggcatcacgcccggtagcgaggcctacaacaacgcgatggacaaccaggcgcgccagcagggattcacgcagtcacaggccgccaacaacgccaccctgcagggcatgcagtaccagaaccagctgttcaaccaagggctgcaaaacgccaacctgcagaacacggcgcaggccggcctgttcgggatcggcatgcagaacgcccagctgaacaacagcgccaaccagcagatgctgcagaaccagttgacgatgcgcaaccagcctctgaacgagttgaacgcgctgcgcaccggttcgcaggtgcagatgccgaacttcagcggcgcacctggcgtcagcatgaaccccaccaacaccatggcggcgactcagatggcctatcaaggccagctgaacgcctacaacgcccaggcaggccagtcggcagggatgatgaatgggctgttcagcctaggcggtatgctgggatcggcctatatgttgtccgatcggcggctgaaaaaggccgtgcaacgcatcggtactggcgtgcgcggcttggcgctgtacgcattccgctacctctggcagtccgaccgcgcaccgcgcaccgtcggctatatggcgcaggacgtccgccgcgtcgcccctggtgcagtatttgatgcgggcggtggcaacctggcggtgaacatgggggcgatatgagcgtattaggattcgtcggcaaagaattggagatgccctggtcggagactaagtggtggggcaacgtgctgaccgggaaaatccccttcaacgacatctacaaaacccacaacgccatgcacgccaactccacgctggagctggggaacggctggacgcaaaaccacccagatgccaccgcggccgccgtcatcggctctatcttcggcggcggcgcgctgatgggggccggcggtgctggcggcgcgggtgctggggccggcgctgccgagatgggcgcaggagccgaggccggagccggagggtacgggctgacggccgcagggtctggcggtgggcttggtggacttgccagcatgggcgctgactctggcgcggccgctggaggatcgacgttcgcggactacggcgtcagcactgccgggctgggcggtgacgccatgcagttcggcggcccataccaagcggctgccggcagttctggcggctctgggcttttcggcatgttcaacaacctgagcccacagcaaaaagcgcagatgatccagcagggattcgggagcatggggaagatggctggtggccagcggcaaaaccagcagcagctgccaccggtagatacctcgatgccgtactccaccatgacccctgcgcctcaacaatcatggagctggaactatggctgacaacatgatgaacggcatgaacttgctgtaccccaacctggcgcaaacccaacagcagatcgagctggaacgccaggtgggcatgcaggccatgaaccagggtatgcaaccgcagccgctccaatcggtggggggcgtggcgattcgacagtccccactggaggggctcgcgcgcatgctgcaaacctggaccggcgcggccatggccaaaaatgccatgtcgcagcagagcgagctgaaccagcagtatgcccaatacctgcgcggccaattcggcgccgacggcgctggcgcgcaaccggcgacccagcaacagagcgacccgggtctatccgatgctggcaacggcagcaatcccgcatatgccgccgcgctgcaggctctggccgagcgtggcgcaacggctgggccaaccaggcaggcgacggcactcgctcaggctctgcaacagtccagcagcggcggcggagatggtggcggcgctgggcagactccggcccctcctccggctacaccgccctctgccggcggcgcatccatgaccctgccgggcatgacgccgcagcaggctatggcgatgtacttgatgaacccagacaaatacaccgaggcgatgctgtcgcagtacaaggcgccggacgtcgtcaccaagttgcgcgccgccggcatagacccgtcgtcgcagctggggcgccaggtgcttcaggacagcatcgccaaggacaactacatcgcacctgtccccgtgcgcccaggcggtggcctggtcgacccgcgcaccggacacatcaccacgatgccagctgctgcacctgaggggttccagagcgtgcaaaccgcggatggctcatgggctatggtgccagtacagggcggcactgctgccgtgcagtcgtccgcacaggccaaagcggccggcgcggctgccgtcaaaccgatgacggcatacgacgccgatggaaacccggttttcaccagcgagctgcaggcgtcaggtggcgcgccggcgggcggtggcggacggttcgccggataccaggctccgggacaagcggctggcggcaaccttcggccggcaccaatcgcaggcaccaacgacagccgcgtcaccatcgcccaggccaacgccaaacgctacaacgacctgacgacggcagcgacggatagccctacgcgcgtcaacgtgctggacaacatcatccagctgtcgcagaacggcgtgaacaccgggccgggctcggcctggcagaacaaaattctggggtacgccgccaattctccggtgctgggatcgctggtggccggcaagaaggacagcgtgacgcaattccaggaaatgcagaaattcctggcccagaatgggctgcggcaatggcaggcgtccggtggcacgggcaccgacagccagctcaacgccgcaatgcacgcgaacccgaacgatgagcatttcccgcaggcgctgcaggcgctggcgacctggaacaaggccggcgaaatggccttgcaagcgaaggcagccgccgccagccagtacatggcgcagcatgggaatgacgccacgcagtacaaccagttcgacaacatgtggcgtcagaacttcgacccgcgcatcgcccagatgcagctgatgaacccgcaggatctgcagcagttcgtcggcaagctgcagcccgcggacaaggcccaactgctgcggaaataccaattcgtcaaacagcaaggatggatgtgatggcaaaccggctcgatcccctcttccacgccgcggcggcccggtacgggatcgacccggacctgttgcgcgccgttcagatgcaggagaacccgaaaggcaacctgtccgccgtcggccccgtgccggcggtcggcgacccgaacgaccgcgccatcgggctgatgcagatccggcagagcatcgccaacaagctcggcatcgacccgcgcgaccccgcgcaggctattgacggcgcggcgcagctgctggctggttcgctgcaacggaacggcggcgacccggagatggccgtcaccgagtatcacggcggcacgaacccggcgaattgggggccgcgcacgcaagactatgtgagcaaggtggctggctacttccagcaattgaaacagcagccccagccccagatggctcaggccgcgaaagccgcaccgccgccggccggtgccgacccgatcatggccgcgctgtctggtacggcagcgccggccgcagccggtagccaggggcagagcgacccgatcttggccgccctgcaatcaaagtcgcctgtgccggttgcccagaccaaagccgcaaagccggctactccagccaccgacaatgtcgctaccacgctgtcggccgtactgccgggcggactcggcaaggatctggcgaacagcggcgtgggcgacttcatccgtgccggtcagcaccacctgctaaatcccgttctgggcgcgtcccagttgctggataacggggtggatgcagggctgcagatgctgccggacaaccctgtttcgcggtactggcatggcgttacccagaacaacaacgcctacatggcgcagcgcgagcagcaataccaggcgaacacgccgaccaacgccgccagcgtagccggcgcagcgattggtgatgcggcaccattcctggccagcggcggcgcgtcgttgctgggccgggccggatctatcgctgaacggctgccgctggtatccagcagcgccagcgcccggcgcattgccaatgccgtcgcccagggcgcaacggtcggtgccatgcagcccgttacgaatgccgtgccgccgaccatgagcgacctgataaccggccagggcagcaaagcgcccagctattggcaggaaaaagcccttcaaaccgccatcggcggtgctatcggtggcgcagtatccggtgcagccaatggcgcgcgcggcctttaccaggccgccaaaccggtaatctcgccccgggcaaccgccgccgacacgctggccgccgcgttgcgcacgccggcgcaatccgctgcaacagcccccgcagttgaaggggctggcgccagcgcggcagcgcctgctggtgctgcgggcccggcagccggcacggcatcgaacgccgccgacctggccgccgcgttgcgcacgccggcgcaacagttcgtgccgggctcgcggccgacgctggcgcaggtgctgcagacgccgcaggccgtacagttggaaaaggccgtctcgaacctgccgcagtaccgggcgatgttcgagcagcgcgcgatcgagaacaacgcagcgcgcctgcaggccatccagggggtagctggtacgccggacgccatggcaggtgcaatccaggcgcggcaggatgccgccggtccgctctacgccgcggcgcgccaggaatcgtatgttcctgactcgacgctgacggatctgctgtccacgccggccggcgcgtcggcgttgcagcgcgcgcgccagttggccgccaactcgatggatcgcgcaccgatcatcaccgacgacggcgacctgaccggcaccggcggccattatatgaagatggcgttcgatgctatgctggacgaagggcaacggaccggcatggcgggcgcagagcaaaatgcgatacggaatcttcgtgggaatttcctcgactggctcgacacgcagtctccaaattacgcgagtgcgcggcaatcgtatcgagacgcgtctgtacccatttccgacatggaggccggacagtcgattctggacaaccttggcaatcgcgctcttaacgccgctggtgatccatctattacgctgaacggctacaactccgcgctggcgcgcgctctgcgcaattccgactacggcatcagcgacgatgccaccgcagccctgacgggcgtccagcaggatctgcaacgttcttccatcagcaacagcctgaaatcatccggtagcgacaccttgtccaacctggccgccaacgactggctgatgcgacagctgaccggagaaggctcgtccggcggcaccgcccagaaagcggcagcggcggccatcggcaccgtcattcctggcgtgggcaccatgggcggctggctcggcgctggcgcactgcaggacgccgccacccggcgcgcggccgaccagttggcgcaggcgctgctcaatcctgacgtggccaaccagctgctgcagagccagactaccgtcagcccgctgctgctgcaggcgctgcgcggcacgccggccgccgccgccaacgttggcgcccaagctgcgccgtaacaccacatcaccccatcgacaagccccgcctctggcggggcttcttcattcatggagcatgaaaatgcgaaacggatcagggcaatacaacccgccggcaggtaacccggttcaggctggcacgctgatggaccccaacgcgttcaacagcaccatttccgacatcgggtcggaaatcaccaacagcgtgccgcgcgatggccaggcggcccccactgccaacctgccgatgggcaacttcagacatacgggggtggccaatggccaggcgcgaaacgactatgccgcgttggcccaggttcaggacaacaccgtccagaccctgaccagcgtgggcggaactgacaccatcgtcgccaccgttctgccagcgtttcagagctatgcagttgggcaggttttccgtggggtaatggtcggctccaatgcgacgacgagcccgacgctgaatatcaacagcgtcggggcagtcccgattgttctacctggcgcgaaaaccgtgtcggtaggcgatatcccggcaaacggcgcggtttttttctacaacgggacgcaattcgttttgctgaatcccgtttcgacatatagccatgttgtgccgaatttaaccgcagtgcgtgcgctcgttaaaaccggtgcgccaaatgcgtttgtaaccgggcacgatgcgcagggggatggcgggggcggaaactattacctcgacccgctggacaccaccagcgcagacaataacggcaccatcatcgtcgccaccgacggcggccgctggaaattgtcccccgtcggatcaaacatcaatgtccagacattcggggcaaaatgcgacggcgtaaccaatgacaccgctgccgttcaggcggcagatatttatgcggctgccgtccataaaaagctgaaaatacccggtgtctgctatttgccgacctatgtatttacgtctgaattagaggacacgatggggcagatgtttaccccgaatagcaacgtcactatatcggcaaacagttttgttcgcccggaatggtgggggacgcaaaacaatatcgtagacctggcaatccacgccctgcctgcatctggcggcatcgttcaactggaggacaaaacctatccgccaaatggatatgcggtgggaatgagcggtgtaggcagcgggaaatatatctccaaggacaatgtaaaactggtcgggcgtaaaatgccgtcgctaaccaacgactgcaaagcgcttactggtggcacgattattcagggcatgctgctggcgtgggcgaatcagtttgaaatgtccgaccttggtattgattgcggctataccgttctgcaaaacgtgtatggaggcgttgaagcggctggcattactgaggcctacaatttcacgtacccggacacaaccaccgctgccagcccaccggctgcaccgaaaatgtcgtccaaactgcataacattatcggattatgcagctctccaggcgcaccgacgcacgccatgctgatcggcgaagggctccaaggcctggaaacctccggcgtgataatggccgtatatggccagcacggcgtcgttataaagtgcaagaacgcattcgtggagcggattgaagcttatatgaatcaatccgattcggttatattcaaggccgatgccggggctacgcaaattgcaggcggcgtagacgtggaaagtatttactgccgagcagctgggccaattaacaccgctccctatgcaacatcgcaatgcaacgctggggtgatgctgaacgcccacgccaataatctggacgatatcaaaattggcaccatccattgcgaagggtatccattctcggtttattacacctgggatggaccctatgcaatcagcagcatcgacatagaccacattttctccgatcaattcggcgtaacggtcgcaggcagaaccgcagtatcaatgaatggcaccgccggtcaaagccttcaacggaacagcataaagtcaatcgatgccagaaatactatattcgcggtcgctcacaatatgcagggcggcgccgggctggtttctgaaatcggccgccttgaggctacaaacgtacagaatgcggtaaatgtgggctatggctctgtattgagcataaacgttctgtctgtcaccagcgccagcgatgcggtgtatttcattactggcagcccgcgactgctggtgaatatgctgttcaaggacgtggcgacacccgccgtttatagctcgctttctggtagcactccgccaacactgtcaaatagctgggcaaatcaaggtggcgtcggcaatgagcaattcggcgtcgatttgctgggcggtaaaatatcgttgaaaggacttttgacgcccgggacttcaaacgtcattgccacgttgccatattgggcgcggccagtatcgaataaacgctatagcgcagtaggctttgtcgctccgaataacgtttattccgtgccaattactgttggctctaatggagtggtcacagtaaatgaagtggtcggcggtacagctaattgctctacctacgtttcgctgtcgggaatttcatacgacatcgtcagctaaatccaagcggccctacggggccgctatcaatttggaggggagtcgatgggagaaagccaggatgtaacggtcgcccggctggacgagcgcatggaagggatgcagcgcgagatgtcggccatggcacagcacatgcaggggctggcgtcggccgtgcaggaaatgacgcgcgcgcaggcccgcatatccaccgtcgaggcgcatatctcgacgctgcaatccgggcaggacgcgatctggaaggagattcgacgcatcgacgggcgccgggaaaacgggattttcgaggtagtgaaactgatcgtctactgcgccgccggcgcgttcgtgtctcatgtagtcagataggagggctcatggccaatttcaacgcagcattcaccgcgctcatcggcaacgagggcggctacagcaacaacccgcatgaccccggtggcgaaaccatgtggggcgtaactaagcgcgtggcggtggccgccggctacaccggcgccatgcgagacatgccgctggccaccgcccaggccatcgccaagcgcgagtattgggacaaattccagtgcgacgcgctaccggatgcgctcgcgttccaggtgctggacgcggcctacaacggcggattccccgccaagtggctgcagaacgccgtcggcgttcatcctgacggccacatcggccaggccaccattcaggccgccaacgccatggaccccgcgcgctcggtgctgcggttcctggcctaccggctggcctacatgaccacgctgcgcacctggccgacattcggcaaaggctgggcggcgcgtatctcccgcaacatgctgaaaggagcagtttgatggacccgatttctatcgctatgggcctggcctcgttcgtgcccgacatcgtgaagtggatcagcggcagcgacaaagccgccgacgccgcgcagaaggtggtcagcatcgcccagcaggtgacgggcacttcgagcggcgacgacgcgctggcggccgtgcgcggcaacccgacgctggcgctgcaactgcagcaggaactggaccggcacagcgagcagctgaaccagatcagccaggcggtacagctggccgagatccaggcggacacggccgacaccgcagcagtcaacgcgacgatgcaggctgaagccaagtcggaccactggccgacctattcctggcgacccttcatcgggttctgcttcgggctgctggcgctgatcagcggcattaccgttgcagcgtgctatctgggggtgatgttcgggggggagaatccgcaggtgctggcgcagctgccggggatgatcggcgcggaggccggggtgatggcgacgatggcgccggtgctgggtatcgcgtcgtggttccggggcaagatgcaggccgacccgcgagtccagacggataacaggggatgatggtgtgacggatttgtgccgccgcggcgcgcgctcgtttttcggccatgtgccgaatccgtgccgcgtcgtggtggtgctgtcctttactgtaccgcgacaaacctcaacttgctaaccggcaaaagatgcaagtcattgtttttaaagcattttacaaaaagacagcggactcgaaatcaggcgtacgtgcgagcgtaccgagggttcgaatccctccctctccgccagcaacgcaaacaagcccttgaggaatcaagggcttttttgttgcctatcgcactcgttcaggatgacgcggtcccctcttcccggatcggccccaacgccggcaggaacggcacttcgcgcgcggccagcagcggaaccgtctcgcgcagaatcagttcaggcacctcctcgccttcccgcgcgccggcgcaaagcgatacggcatgcgttcccgccagcaccccgtgccagaaatgccagcgcccatcatcggcatggcccgaaccccgccgcgcataccgcagcccgccctgatcgtcgtcgacgaaagaaatgcagtccagcggcgcgcttaatccgcaacccagcgccttcagatacgcctccttcagcgtccacagcgtccagaagcggtcggcctgcgcctgcccctgccgcgccgacagctcgcgcgcctcgtcgcgcgagaaattttcccaggcgacatccagcgccgcccgccgctcgacgccctccacatccacccccagctcccggtcccgcgccagcgccagcgcgaccatgcccttggtgtgcgacaggttgaaacgcaggccaacccccgccgccgcgccgcgcaggctgggcttgccatacgggccttgctgaaactcgatgctggccggactcatacccagcgcctctcccagcactgttcgcgccagcgcgcgcgccaccaggtagacatgcctgtcgcgatcgaacgcgaaagcgcgccagcgcgccgcctcttcatccgacaacagcgcgatgtacgcctgccgcagcgcagcgtcatcgcaacgctcggtaggcgccgcccatatctggataccctcagccatttcattccgcctgaaattcaaaaccggcgcttgcctgcgccgccaacacgataaagccggcaagcgtaacgcaggaaaacgccgccgatcaaatccaggcccgccgccagtggggacctggcgccgcgcccggagcgggcatgctaggatgaacgggcaaatgcatttggaatgccaaacaacccggagagagccgcatgagcaaatcgcaacgcgtggaaaccgacagcttcggcccgatagacgtggccggccacgccctgtggggcgcgcaaacccaacgctcgctggcgcacttcgccatctccagcgaaaagatgccgccagaactgatcttggcgctggcgcgggtgaagcgcgccgccgcgcttgccaacctggagctgggcctgctggacggcgccaaggcccaggccatcgtcaccgccgccgacgaggtgctggcggggcgccacgacggacaatttccgttatcggtctggcagaccggctccggcacccagagcaatatgaacatgaacgaggtgctggccaaccgcgcatccgagcttttgggcggcgagcgcggcgtgcgccggctggtgcaccccaacgacgaagtcaaccgcggccagtcgtcgaacgacatcttccccaccgccatgcacgtggccgccgcgctggggctgagcgaacggctgctgcccagcctggctgcgctgcgccagatgctggaagccaaatcgcgcgaattcggcggcatcgtcaagataggccgcacccatttgcaggacgccacgccgctgacgctcgggcaggaaatctcaggctgggcggcgcagctgcagctggcggaacaggcgctgcaagccagcctgccggccttgtgccagctggcggcgggcggcaccgcggtcggcaccggcctcaacactcatccgcatttcggcacccgggtcgcggaagtgctgtcgcagcaaaccggcctgcccttcgcgtccgccgccaacaagttcgccgcgctggccggccacgaacccttgctggccgcccacggcgcgctgaagaccctggcggccgcgctgatgaagatagccaacgacatccgctggctggcctccggcccgcgctgcgggctgggcgagctgactctgccggaaaacgagccgggcagctccatcatgcccggcaaggtcaatcccacccagtgcgaggcggtgaccatgctgtgttgccaggtgctgggcaacgacgccgccatcgccatcggcgccgcctccggcaatttcgaattgaacgtgtacaagccgctgatcgcgcacaatttcctgcaaagcctgcgcctgttgagcgacggcatggccagcctggccgagcattgcgtgcagggcatgcagcctaatcgcgaccgcatcgcccaattgctggagcagtcgctgatgctggtcaccgcgctcaacccgcacatcggctacgacaaggccgccgccatcgccaagcacgcgcatcagcatggcggcacgctgcggcaggcggcgctggcgctgggccatgtcagcgccgagcaattcgacgcctgggtcaggccggagagcatgatttaagcgtccgccgaattcagcgggaagacgccggcggcaaagaaaaaagggcgggatccaaacggacccgccccttggcatgcgatatggcggcgttcaggactcgtagccgcgcggattggcctgctgccaacgccagctgtcgcggcacatgtcgtccagcgtgcgttcggcctgccagcccagcgcctgcgcggccttgcccgggtcggcgtagcagcaggcgatgtcgccggcgcggcgcggcgccacctggtaaggaatctcccgtccgctgacgcggccgaaagccttgatgatgtccagcaccgaatagccctgtccggtgccgatgttcaccgtcagcacgccgtccacgcccggcagcgcctgcaccgccttgacatgggcgatggccagatccaccacgtggatgtagtcgcgcaccccggtgccgtcgggcgtcggataatcgccgccgaacacgctcaagcgcggcagcttgcccaccgccacctggctgatatagggcatcaggttgttgggaacgccattggggtcttcgcctatccggccgctggcgtgcgcgcccaccgggttgaaatagcgcagcaggcctatcttccaaccggcctccgcgcgggcaagatcttcgagaatctcttccatcatgcgcttgctgcggccataaggattggtgatcgcgccgatcgggaaatcctcgcggatagggacggaggcgggatcgccgtacacggtggccgacgagctgaacacgatctggcgcacctgggcgcgccgcatcgcctccagcagcgtcagcgtgcccaccacattgttctcgtaatagcgcagcggctgcgcgaccgactccccgaccgccttcagcgcggcgaagtggatcactgcgtcgatccggtggcgggagaagatggcgtcgagggcggcttggtcgcgcacatcggcttcgtggaatgccagctcgcggccggccagctcctgcacccggcggatcgcctcgaatttgctattgcagaaattgtccaccgcgacgatgtcgaagccggccgccagcagctcgacgcaggtgtgggatccgatataaccggcggcgccggtgacgagaatggttgcgctcataatgatctgttcagtccgttttcagctgcgaagccggcggcgctccgccggccagggcatgcctgtccgcattcatgtcagcaaaagggataatcagccggcagaccgctggcgggagaggccattcggcatagcgcccgatggtaacacatcggagccggcgcgccggggccgagccaagcgggacaagcgtcaaacggcttcgacgttgttgtggacctcgctgtcgcgcagcaccacctgcgcccacaccaccgagtccaggtagtactggttggcgaggtcgaggtcgaaatccagcaccctggccagggcctcgatctggacgttgtcgccatgctcgcaagccaatgccagcgcgagatagggagcgaagatgcccttttgctcgaccaccgcctcgcgcaccgtcaacggcagctccagcgggtcgagcacatcggggaagggaacattgagcagcacgtccagcagtgaaaacatgccggtgaggaacaggtgttccgattccagcttgttgccgcggtaactgcccagtttttccaggaaacgcgcgcggatcagcgacttttccagcagggaaaccgcggtgccgtcctccttgcgcgaagtgaacaatagcatcgacagccacttgaacatggtttcccggcccagcagcagcagggtttcctctatggtctgcaccttgcgcgccaggccgtggatcggcgaattgatgaagcgcagcagcttgaacagcagcaccgaatccagcttgaactgcgcctccacttccttggggtcggcattggcgcgcagcagccgcatgatctgcagcacgcgggtctggctggtgtccaccttgccgccttccagcgcgtgggcggtggtgacgaaggggccgtggaacagcgcgaagcggttatgccccggcgcgcgcaggcagacatccagatcttcggcggtgccgacattgcgcgccatccagcgcgcgcccggatagcgcttcggcaattggtccagaatgggcgccagcacccgggtggacgggccggcgaagtccagcaccatgaagtcgacccggccgaacaagtcggcctgcaaggcggcgctcagcgcgccctgctcgtaagccgccggctccaccgcgaagcgcaggcccagcttctgcagctggtccagctgattgagcatgtattcgttgactatcatgcccggccccgcttccagcacgaaaatcacgctgccggcgggcatgtcgcgcagcagcggttcgtccagcgaggtcatcgagatgtgcacgaaggcgcggcggtaggccagcagccggaagatgtccatattctgcaaggtggccagcagcagccggtcgaactcctgctgcttgccggcctcgacattgcgcttgccctgccggacgaaaaagtcgtaggcgaccacccgctgctgcttgtccatcaccggctggtgggagacaaagcccagggtaggcggcagatccaccggctcgtcgtcgggcggcggcggatccagcagggttctgtccggcttggccgccgcggccggcgtctcttcctctgtcgtcgttttcttcaggcgtccggccaagccatcaatcagacttttcagcatggtgccatcctatcgggagcggcctggtcgacttccggccggtatatcaatactagccgatgcgcccggcaattctgggcgtttccacccgcacatcgccgcactgcgcgcggtggcgcagcgcgtggtcgatcagcaccaaggccagcatcgcctcggcgatcggcgtggcgcggatgccgacgcaagggtcgtggcggccgtgggtttccatcgtcaccgcctcgccttgcttgttgatcgagcggcgcggctgggcgatggacgacgtgggtttgatggcgatggagacgtcgatctgctggccggtggagatgccgcccagcacgccgccggcgtggttgctggcgaagccctgcggcgtcaactcgtcgccgtgctcgctgccgcgctgcgccacgcagccgaagccggcgccgatctccacgcccttgaccgcgttgatgctcatcatcgcgtaggcgatgtcggcgtccaggcggtcgaacaccggctcgccccagcccaccggcacattgtccgccaccacgcgcaagcgcgcgccgatggagtccaggctcttgcgcacgctgtccatgtaatcctccagccgcggcacgatgtccggatcggcgctgaagaaggggttgccgccgacatgttcccaccccttgaacgggatggccacctcgccgatctgggtcatgtggccgcgaatgacgatgccgtatttctcgctcagccatttcttggcgatagcgccggcggcgacgcgcaccgccgtctcgcgcgccgacgagcggccaccgccacgcggatcgcgcaccccgtatttatgccagtagcagtagtcggcatggccggggcggaaggtgtcggcgatattgccgtagtctttgctgcgctggtcggtattgcggatcaacagcgcgatcggcgtgccggtggtcttgccctcgtagacgccggacaggatttccaccgcgtccggctcgcgccgctgcgtgacgtggcggctggtgccgggcttgcgccggtccagctccagctggatgtcggcctcggtcagcgccaggcccggcgggcagccgtccaccacgcagcctatggctggcccgtggctttcgccgaaggaagttaccgtgaacaagcgccccatgctattgccagacatctgcatttcccctgcgtcattgcgtattgcgatcgattctagcacggcccatcgcggtgcacgcctccggctgccccgcgccggaatcaggcccgccccgcgacgcgcccggcaaaacagccggcaaggctggcattctttttgcatacttaaatcagacggcatagccgcactttctgagcgcaagcaagacaatcaacgggataaagccatgagcgcatcgacacaagcattggcccgcaagctgggcggctggcaactatgggggatcgcggtggggctggtgatctccggcgaatacttcggctggagctatggctgggcccaggccggcacgctgggatttctctgcacctcgctgttcgtggccctgatgtacaccgccttcatcttcagcttcaccgaactgaccaccgccatcccgcatgccggcggccccttcgcctatgcgcgccgcgccttcggtccgctgggcggcttcatcgccggcttcgccacgctgtgcgaattcgtgttcgcgccgcccgccatcgcgctggcgatcggcgcctatctgaacgtgcagttccccggattgcaagccaagtggaccgcctgcggcgcctacctggccttcatggcgctcaacatcgccggcgtcggcatcgccgccgccttcgagctgtgcgtcacgctgctggccatcttcgaactgctggtgttcatgggcgtggtggcgcccggcttcgactgggccaacttcacccgccacggctgggccagacaggacgggtttcattggggcgcggtcggcggcatgttcgccgccatcccgttcgccatctggtttttcctggcgatagaaggcgcggcgatggcggccgaagaggccaaggacccggcccgcaccataccgcgcgcctacatcgccggcatcctcaccctggtggcgctggctttcggcgtgatggtgatggccggcggctccggcgactggagcctgctggccaacatcaacgacccgctgccgcaggcgatgaagctgatcgtcggtgagcacagcagctggctgcacatgctggtctggctgggcctgttcggtctggtggcctcgttccatggcatcatcatgggctattcgcggcagatcttcgcgctggcgcgcgccggctacctgcccgcctggctggcggcggtgcatccgcgcttcaaaacgccgcatcgcgcgatcctggccggcggcgccgtcggcatcgccgccattttcagcgacgacctggtgcagatcgccggccagccgctgaccgccaacatcgtcacgctgtcggtgttcggcgccatcgtcatgtacatcgtttccatgctggcgctgttccggctgcgcggccgcgaaccggcgctgttccggccgttctccgcgcccgcctatccctggctgccggcgcttgcgctggcctgcgccacggtgtgcctgctggcgatggtgcgctacaacctgctgctggcggcgatttttgctgttacgctgctgctgggcttcgcctatttcctgctgacgcgcaagcagcgcgacgcggccggcggcgacgccatgctggaggggacggccgacgccgcccccgcgccccaatccgcccgagcgccgacatgagccacgccatcaccgtaggaccgcgccgttaccgtttcgacgacctgaaaaccctgctggcgcgcgccagccccttccgctccggcgaccagctggccggcgtcgccgccgccagcgccgaggagcgggtggcggcgcagatgtgtctggccgacctgccgctgaccgtctttctcaacgaggcgctgatcccgtacgaggaagacgaggtcacccggctgatcctggacagccacgacccggccgccttcgccgccgtatcgcatctgaccgtgggcggcctgcgcgactggctgctgtccgacgccgccaccgcggaaacgctggcggcgctggcgccggggctgacgccggaaatggcggcggcggtgtccaagctgatgcgcaaccaggatctggtgcaggcggcgaagaaatgccgcgtcgtcaccgccttccgcaatacccagggactgcccggccgcatgggggtgcggctgcagcccaaccatccggccgacgacgcgcgcgccatcgccgccgccacgctggacggtctgctttacggcgccggcgacgcggtggtgggcatcaacccggccggcgacagcccggacgacatccgtaccctgctgaccctgctggacgaagtgcggcagcgctacgcgatcccgacgcagagctgcgtgctcacccacgtcaccagcacgctggagctgatccgccaaggcgcgccggtggatctggtgttccagtccatcgccggcagcgagaaagccaatgccggtttcggcgtcagcctggccgtgctggacgaggcgcatcaggcggcgcgggagctgaagcgcggcacggtgggcggcaacgtgatgtatttcgaaaccggccagggcagcgccttgtccgccaacgcccactggggcgtggaccagcagacctgcgaggcgcgcgcctacgcggtggcgcgccgctactcgccgctgctggtcaacaccgtggtcggcttcatcggcccggagtatctctataacggcaagcagatcatccgcgccggcctggaagaccacttctgcggcaagctgctgggcctgccgatgggctgcgacatctgctacaccaaccatgccgaggccgaccaagacgatatggacgcgctgttgacgctgctgggcgcggccggcgtgcatttcatcatcggcgtgcccggcgccgacgacatcatgctgggctaccagagcacctctttccacgacgcgctctacctgcgcaatgtcctgggcctgaagcgcgcgccggaattcgaagactggctggagacgatggaaatcacccgcggcggcaagctgctgccgcaggacaaacggcagcggctgctggccttgatggagagcgtggcatgaaggacaagaacccgatcaccgaggacggctggggcgagctgtctcggctgaccgccgcccgcatcgccctaggccgagccggcaacagcctgccctgccgcgaaaccttgcgcttcgccctggcccacgcccaggcgcgcgacgcggtacacacgccgctggatgtgtcggccttggccggcgaactggcggccgacggccatcgcgttgtcgaaatccacagcgcggcaagcagccgcgccgaatacctgcagcggccggacttgggccgcaggctggacaacgccagccgcgaacagctgctggcggagcaggacaaaggctgcgacctgctgattctcatcgccgacggcctatcctcgcgcgcgcccgcccaacacgcggttccgctgctgcgcgagctgctgccgcgggtgcgggagctgggcctgaacgtcggcccgctgctgatcgcgcgcgaggcgcgggtggcgctgggcgacgaggccggggagatcatgcaggcgaagatgacggcgatgctgataggcgaacgccccggcctgagttcgcctgacagcctgggcctctatctgaccgccgcgccgcgcgccggccgcagtgacgccgagcgcaactgcgtgtccaatgtgcggccggacggccttccctacccgctggcggccttcaagctggcctggctgataaacgccgcgctgcgccagcccaccggagtggcgctgaaggatggcagcgcaacagatccgcgctgggcggcgctgttggcgagacaggcctgcctagtcaaagactgagcgctagcacagctcgtatgtgtccgctgcgcggacagtattttaagtgccggttccgcccggcaaacgggccaggggctgtgcagccagccctgtcgctgagcgagtcaaagattcgcacgcagaggcgatcccaggccgcccctgcagcccacgaaaccccgacaaaaaagcgtctggccaggagccgccgacactacatgcgtgcgaatctttgattcgctcagcagtacgcgctaacgtcgcgcggcgtcgaacaagtcggcggcttaaaacccggccagacgctttcttgccggcgtgcgctgaaggggaatatggtcgcgcgaaaatggatctgcctaaagcaggaaaatccaagtcgatgacctgccgctacgaccgagctctatcaaacatgcaatttaagaggcgcaatccaacatcaaggcttgccataatcctcaccagggcaaactgccgccctggcggcgataccagccggtgaccgacaaacgctgttgcttggccggcagcacctcgtgccagaaacggtcggccaggaacagcaccagggtgccggcttccggctccacatcgatgaaccgctcgcaggcgtcgtccaggtacaggcggatctggccgccgccatcggccggccagttttcattcaggtaaaacaccgtggtcagcgcgcgggcgtcgtcgtcgcggaaacggtccagatgctttttgtagaacgcgccttccggatagacggcgaagtgagactccaactcgaccaggcccagatacaggccgcggttcaccgccagcatgatctcatccatcgcggcgttgtaggccagcaccgccggcagctcggccacctggtccagccacagcaccgagtcggagcggatctcggcgcggcgcgcctggccgccggcgcggccggtggcggcttcgtggaagcgtccctcgtcccacacctgcaggcaggcgtcgcgcagattggcgaccagttcggccgacaaggcatggggaatgacgatccagccctgatctgccagggtgtcgagtacggcttcgagttcgaattgcagcgcagtcatgtcggtcttgctgaaaaaatgggcagacgctttctaccacaggccgcccccgctggccaatgccggatatcaatcctttccgctcttccggatcgccatggcgcctgcggcgccctctcagcccagctggcgcgatgacgaaatggcggacggggcattcggcaacgcggatagcgccataggaaaagggagcccaatcacggctccctttctcgcatggcgacgctttaggcttgcggcggcgtgccctcggcattggctaccaccgcgtcgatttgaatcatcgcgccgcgcggcaaagccgaaacgcccacggtcctccgcgcgggaacgccgcccgggaagaatgccgcgtatacctcgtcgaccgcatcgatctcggcgatgttcgtcaggaaaatattgaccttcaccacatcgctcatcgcgtggcccacgctttccacgatggctttgatgtttttcagacactgtctggcctgctctctcacatccccgaccaccatttcattcgtctctgcgttcaaaggcagctgagcggaaagatggttgtaatgagagaaagccaccgtttgcgtggcaagcgcgcatcggggagctttttcggtgttatgcgccttgatcacaatgccgtgccgatcttcaaccgcttgcggcggcgtgccgtcgccatgcgacacaaccgcctcaatctgaaccagggcgtccatcggcagcgcggcgacttcgaccacggtgcgagccggcacataagccaccgcccgggcgatagccgaatccgggaaaaacgcgcggtaagccgcgttgacctgctcgatatccgacaggttcttaaggaagatattgattttgacgatgtcgtcaaacggaacggcgatgctttccagaatcgccctgatgttttgcaagcactgggcagcctgctccctggcgccgccggccaccagctttccggattggggatcaatcggcaattgcgccgagatattgttgtaatgggaaaaggccaccgattgagtagacagcgcgctggtcggcgcctggttcgtattgctggcgattttgaccagatcgccagcctgcggcgcattgggaatggtgccctcgccattggaaagcaacgcttcgacttgcaccaaggcatccagaggcaaggcggcaaccgcggctaccgtcagagtggggacataattctggaagaaagtcgaatagacatcgcttacgctatgcatatccgagatatccttcagaaaaatggtgattctgaccgcatcatccattacatggccgatgctttcgataatcgccttgatattcctgaagcactgttcagcctgttctttcgcgccgccagccaccagcttcccggtcatcggatccaccggcaattgcgccgacagattattgtaatgtgagaaagcgaccgtttgggaatacggcccaactcccatgggcgctttttccgtattccgggccaatacggcattaaaactgctcgtcatgatcattacctgttcagtttgaattcaacccgcagcgtcgccgcatgcatatcgcttcgccatcgatagttgccattgctttatccatgcgacgctttaaccattaccgcgctgatttaaaaatacgatggataaaatcacaaacttgatcagggctggcttagcggagcgccggaagcaacgcaatcacaatagcgattttatcgaggagccgccctggactgtcaatgcggtttctcaacaaataaaatcaaaccgaaaactcggaatcaatagaacattgccacgacagggcttacttattctgcatgtctcatttttgaataaaaccgcgctttcagacccatgccattcattgaatgacaatgcccatctcatctacacattcggcaaatacaaaaccgaacatatttccaaagggcaggatttgacgccgatcaagattgacaggcgacacaggatgatattagccagcctgttgcgcgaaaaatcgaaaggaaaaataggcagaagcctagccatatcatagccggcttcaaaatggggacatccatctgccgcagagcgctgcggggacaaaggattatcaggcgcctgctcgcgccgcttcacaaaccatgtgcccgaagccaaacaccgggcgaatggcgggagatccagaccgacgacgatctgggccatcccgcccgatcaggctcaataattctccgccaccgcgtcatagcggcccgccagccagtcgagcgccagcgggaaatggtcgcgcggcgcgtccgggtgggtcagcagcgacacgtggttgtaatcgtgcagatggccggcgcgccgccccaacaggtgcagccgcgacagatgcgggccggattcgtcgcggaagcggcgcacgtcttccggatggccgcggcagggatcgttggcggcggcaaaatacaggaccggcggcagatggccggcgcgcgcggcggcggcgtaatcgaagccgtcgtcgctatccacccacggcttgggctcggcccacagcttgctctgcagatggctcttgtcgctctcgtcgtcggcccccaaccggatgcgccgcgccggcaggtagccgcaggccttgatcagccaacgcacggcggtactccacatgaagtctacctcgatcagcttgttcaggttgcgcacccgcacgctgcgcttggagccgaaatacaccgcgctcgccacctgggcggcaatgtcggggaagcgcaccaggcagctcgtcatgtgcacgccgccccaggagtgggcgatccaatgcacctgctggccgccgcttttcctgcggacgaaatcgtgcagcgccggcaggtcctcgcaaatggtttcggtctggccgtggcggctgtccgggccgatcttgggcgtgctgcgcccgcggccgcgcaggtcggccacatagatgtcgtagccggcatcggccaggaaatgggccagccccttgccggattcagtataaaaggtgcggccattggccatcacgccgtgcaccatcagcaccggcgcgccgccttcgcggccgcagatgcgcttcagatacagccgctcgccgtctcccaccggcacaaacaggtcttgctgcagtttctccattttgtcctcgcaaggtgatgccgccgctgtctgcgcagcgattcaagcaaacgcttgatcatgacaaagaacccggcaaaggaaaagccgcacccgcatcctgccgccgcaagcgcaaccgttcgctgaagacggccagtcccgcgcccagcccgcacaacagcgccagcgaggcgaacagcgtccaggccggcccatgcgccagcaacgcgcccgccagcgccggcccaagcgcgccgcccagcgaggccagattctgcgcgccgtaatagctgcccttcaaggcttccggcgcgatggcgtcgatgtacagatactcggccggcaccagcaccacctcgcccagcgtgaacagcgcgatggccgcgcacatccaaggcaagctgtccacgccgcccagccacagcatgccggcgcctatcagcagaaagccccccaccaccgcgtgcaccagccgcttgggttgcagccagcgtcccagcggatattgcagcagcaccaccacgaccgcgttgcagctgatcagcgccgacatccagcgcatcgcctcggcctcgcccatccgcgtcagcagatatagcggcagatagctggagaagcgcccatacaccacgtaggccagcaagctgctcaaagtaaaccacaccagcacccgatcgccggccagcgtgcgcacggttgcggcaaaaccgtcgggcaactcggacgcatccctggccgcggctggcagcctgggctgaaccagcaatccggccagcgccagcgcgcctcccagccagaacggcgccagctcccgccacataagcatgccgctgcataacagaggccccaccgcccacgccacattggccagcgtgtagcgcagcgaaaacgccctggcgcgctgcggcgccgccaccagatcgctcaatatcgccttcaccgcgatgccgtacagggtcatcgccaattcgccggccgccagcgccgccacaaccagcgtgtagccccggccgtacggcagcagcacgctgcccagcgccatcagcaccgccgccgcgcgcaaggccgggccgcgcggcagccggtccagccagtagccgccgtatagcccgaacagcgccgaagccagcaacaccgctcccagcaagccgccagtggcctgcaaggacaaaccaagctggcgcgccaaagtcagcaccagcaacggcatgatgaccgcgcgcgacaaagacaataaaaaagacgacagcaagacgcggcgaacaacgggagcatgcggcggcacggcggtaccttgtcaaatgatgggaacctgcgcagtattgccaaaaaagcggaatataaaaatggatgaaatccataataaatacttccgctttatcttcccatcaccaggaacaagcatgaggctgcaacaacagtaccagcggctctacctggcctatggcgacgcgccggcgcagcccggcctgccgcaattggccgaactgtggcaatgcggcgagcgcaatgcgcggctgcaactggccaggatgcgcgagctgggctggctggcgtggcagcccggccgtggccgcggcaagcgctccaccctcaggctgctgcggcggcccgacgaactggaatggcagcgcctgcagcggctgctggcgcgcggccagctggagcaagccttctcccagttggagccggcgcggcagcagcaactgctgtccgccctgcccgcccacctgggcgccagcgacagcggccgcagcctgcgcatccccatcccgcacgcgccgttgacgctggacccgcagcaggtcaactcccggctggaagcgcacctggtgcggcagatcttcgaccgcctgtgccgccacgacaagcagggccgggaattgcggccggcgctggcccacagctgggaaagcggcgcggcaggccggcgctggcgcttctggctgcgccctggcctgcgcttccacgacggctccgcgctggatgcggacaccgccgccgcaagcctgctcaggctcaagcaagcggacaatccctgccaggcgctgtacgcccatctgctgcaagtggatgtccacgacgcgctgtcgttcagttgccagctggcggaacccgaccaactatggccgcagcggctggccgccgccaacgcgtccatcgtgccgctgcggcgcgacgccgacttcgcgcgcctgccggtgggcagcggcccgttccgtgtcgagctgcacagcccgcagcggctgaagctggccgcttacgagcagcactaccgcgagcgcgcgctgctggacgcgatcgagctgtggatcatcccatcgccggacgagcaggatttccatctgcggctggaatacggcaaccagcgcggcgccaccatgctgcaatcggcctgcacctatcttttgctgcgtcccggcggcgcgagcatccccgacggccaacgcctgccgctgatgagtttcctcgccgcgccgcacccggtcgccgccagcgaggagcgcgcgccggcgctgggcttgcagccaggctggatccatccacgcccggccgctgccgcgccgccccggttgagccgcggcaagctgacgctgtttcattacgatctgccttgcttcccgccgttggcggcggcgctggcggaacggctgtctgcgctggagatcaagctcgacatccgctgcctgacgcgccgcgacttcttcaactccgccgcctggctcgaacaggccgacctgatcttgtgcagcgagctgctgcacgacgaccgcgactacggcatgttcgaatggctgagcggctgcagcacgctgcagcttggcctgtcccccgccgcctcaagccgcttggccggcgacatgcgcggcctgcaaggcgaagcggcgttcgccgcgcgcgaggacggctaccgccgcgccggcgactggctggtggccgaaggctggctgctgccgctgtcgcacgagacgctgggccacgacgccagcccgcaactggccggcctgcagctgggcggcaacggctggaccgacttcgccggcctgtggctgcgcggctgagttgacccgcgtcaaacctgaacgcgtcgcccctcttgaaaccgcggccatgcgcctcatctttgcctccaggacggcaaaccgccgtaagccactgaaccgaaaggagaagcaaatgagcatgctgcctgcccgccatagcctgtttgacgagtttttccgcgacttcaccccgggtttcttcatcaagccgctgcatggcgacgcgccgccggcgcagatcaagatggacgtcagggaaaccggcgaggcttaccaggtggaggccgaactccccggcgtcggcaaggaggacatccatgtcgagatcgacggcgcgctggtgacgatccgggccgaagtcaagcagttcgaccagcaaggccaggacgagcgcgcgctgcgcagcgagcgctactacggcctggtgtcgcgcagcttccagctgccgcaggaaatcgaccgcgaagccgcggcggcccgctacgaaaacggcgtgctgaacctgacgctgcccaagcgccgcaacggcggcggcggccagcggctgcgcatcgaataagcgcgcttgccgccatgaaaaaacgcaccgggcgaccggtgcgtttttcatggcgcggctgacgctccagctcgcgccggacggaaggcccagagaggcattctgccctatgcgcgctggaacacccggcgcgatcaagccaagatcttggatacgatctcgtacacgtccttcgacaattcggccttctccatcctgcgcaattgctcaagcatcagcgcctggcggcccggctccagcttcttcagccggcggaaggcgcgggtcaggccgctggcgccctgcggattgatcgggtccagctccaggatgcggtcggccaggaagcgatagccgctgccgtccgcggcgtggaacactgccatattgccgccgaaagcgcccaacaaggaccgcaccttgttggggttcttcatgctgaaggctggatgcgccaatgccgcttcgacatgctgcaaggtgccctgcagctggctgccgccgatcaggctgaagaacttgtccatcaccagcgcgtcatcgttccagcgcgcggcgaaagcggtgaagcacgcgtcgcgctcctcgccgtcgcggtcgcgcagcgccagcagcgcgcccatctggtcggtcatattgtccgcgtccagacactgcttggccgccatctccgccggccaggcgtcgtccagccggttcagcatccacaaggcgcggtttttcaggctgcgcttgccggcgtcctgcggcttgtagtcgcgggtgaggttgagctcgtaagcctcgcgccattcgccgcgcagcgcttgcgccagctggtccagcacgaaatcgcgcacttgatggatgaccgccggatcggcgacatccaccatttccaggatttcggcctcgctcggcagcgtcagcatcagcgccttgaaggccggatcggcagcatggtctttcagcaccgcgcggaaggcggcgacgaaggtttccgacagcttcaattcgcggccggcggcggcgtcggcgatcagttgcttgaacaggcgctcggcgaaggtctggcccgcctcccagcggcagaagctgtcgctgtcgttggccatcaggaacaccagctggtcgtcgcgccagtcgtattccagcttgaccggggccgagaagccgcgcagcagcgacggcaccggctcggccggaatgtcgacgaaggtgaagctctgctcggcggccttgacgtccagcacgcgcgaagcgccggccgcctcggcctcgcccttcaggcgcagcggcaggtccttgccgtctgcgcccaccaggcccagcgccagcgggatgtggaacggcagcttgcgctcctggcccggcgtggccgggcagctttgcttcaccgtcaaggtgtagctgcgctcggccggattgtagctggacgacaccgccaggcgcggcgtgccggcctggctgtaccacaacgcaaactgttccagatccgcgtcgttggcgtcggccatcgcggcgcggaaatcgtcgcaggtgaccgcctggccgtcgtggcgcttgaagtacaggtccatgcccttgcggaagccgtcgcggcccagcagggtttcgtacatccgcaccacttccgcgcccttctcgtacacggtcatggtgtagaagttgttcatctcgatatagctgtccggccggatcgggtgcgcggtcgggccagcgtcctccggaaactgcgacacgcgcaggcccttgacgtcctcgatgcgcttgaccgcgcggctgttcatgtcggcgccgaattcctggtcgcggtagacggtcaggccttccttcaggctcagctggaaccagtcgcggcaggtgacgcggttgccggtccagttatggaagtactcgtggccgatcacccgctcgatgccttcgaaatcggtatcggtggcggtgtcctggcgcgccagcacatacttggtgttgaagatgttgaggcccttgttctccatcgcgcccatattgaagtcgccgaccgcgacgatcatgtagatgtcgaggtcgtactccaggccgtagcgctcctcgtcccacttcatcgagtggcggaccgagtccatcgcgtgctgggtcttgtcctggtcggccggttcggtccagatctccagcgccacttcgcggccacgcatggtggtgaacttatccttcaaggccaccagcttgccggcgaccagcgcgaacaaatacgccggcttgcggtacggatccacccatttcacccagtggcgcttcttgtccaccatgccctcgcccaccttgttgccgttggacagcagcaccgggtacttctgcttgtcggccttgatggtggtggtgaacttggccatcacgtccggacggtccagatagtaggtgatcttgcggaagccttccggctcgcactgggtgaacagattgccgccggacgcgtacaggcccatcaggctggtgttggcggccggatcgagctcggtctccacctccaggatgaagctgtccggcacgccgcgcaccgtcagcgtgtcgtcggccaacgcgtagcggctgtcgtccagccgatcgccgtccagcgtcacgctcagcagcttggcgctgccgctcaatgccaggtcggcggcctgcgactggccgttgcgggtgatcaccagccgcgagtgcacgcgggtggcgttgtcctcgatgtcgaacaccaggtcgacgcggtcgatcaggaaggccggggcctggtaatccttgcggtacttcacttctggctgctgggccatgaaacctcctttgcgccggcgtcgccgccggtctcattcatagacgccgcggcgccgggcagggcgccgctttcgcttgttctctatttccggctcaacggccggctatccacttgccggcctgcggctgcggcttgaggcggcaggtatccgccggcgccgcctgcagcgtcagctcgaaagccatcagttcgtcgcggcgaaaagcgtgcagcttgatcttgtcgccggcctggtagcgggcgatctgcttgtccagatccacggcgcgcagcttgtccaccgccaccaccacgtcgccgccggacaggccggccgcttgcgccgcgccgccgtccagcacatgggccagcttgacgccagcggcatcgggcgcggtcttgacgcccagcgccagcggcgccggcttggcggcgaaagcctccaccacgccgccgcggtcggagccgccttgcgccgcctcgaattgcagttcgatgccctggctggccagcagttcagccagcggcagctccgcggtggagcgcagcgccaggtcgaagaagggcttgaggtcgaggccggtggtttcgatggcgatcttctcccactcgtcctcttccaggcccttgccgtcggccagccacttggcccacagcgcgcgcatcacgtcgtccagcgactgcttgccctggctgtcgcggcggatcagcaggtccagcgccaaggccgccagcgagcccttggtgtagtagctgacgatgctgttggggctgttctcgtcctggcggtagtacttggtccacgcttcgaagctggattgctccagcgtctgcttcattctgcccgcgccgcgttgcacgccggtgatggtttcggccagcaggcccaggtagcgtttctcgtcgatcaggccgctgcgcaccagcgccaggtcgtcgtagtacgaggtgatgccctcgaacgcccacagcaggcgggtatggccttcctggttcagatcatacggcgcgaaaaccgccggcttcatccgcttgacattccagctgtggaaatattcgtggctgatcaggcccagcagtttcaggtagccgtcgctgatttcggtcgcgcccggcgccggcagatcgtcgcggttggccaccagcgcggtggacgcgcggtgctccagaccgccgtagatgtccttgccgacgaacagcatgaacacgtagcggtcgaacggcgccggcttgccgaacatgccgatctggtattcgcagattttcctggtgtcgtcagccaggcgcttgaggtcgccctggaagcggccggacacgacgaattcgtgcggcacgccgcaggccttgaagctgaccttgtggaaatcgcccagctccaccgggtggtctatcaattcgtcatagctggacgcctggtagcggccgaagccggatttcttcttcacgtcggcggccggcaggctggtggccactttccattcagcataagacttgccttccggcgcatggatatccacgctgcaggcgtcgttctcgtagccttccgccgccaggaacacgctggtgccgttgaagaagccgcgctcgctgtcgaggtaggcgccgcgcaccgacagatcgtaggcgtaaacctgatagctcagcgtcagcggccccttgaccgggtcggcctgccagcggtttttcgccaattgccgcaaagccaccggcttgccggccgacgcggcggacaaaccgctaatgtgcttggaaaactcgcgaatcatataactgccgggaatccacgccggcaaaaaaaacacctggccgttcttggccgggtgcgtcacggtaaggctcacttcaaacaggtgcgcggccggcgaaaccgggcgcagcgaataatgcacgggtagggactgggtcatgatcggcctgcaagcgttgcaaaacttgatgattctagcattaccgcggatttcgcggcgtcactcgtgctgcattgatccatgtcaatgagcgttgccgacaggacaatacaattgcatgagtggcaacatgaactgttcacattgctacccttgaaacatcgcgcgtaagacatgcagggaccgatccatgccggctatgcaactggctcgcatatggcaattgatttagaataacggcattgttcgagtggaaatttggtgctgtcggaaaggctggcgaaatgctaatacagacatcaaagcctatcagtacaggtcaagcacctggttcaactttgaaatagatcggttccccgcggctgacttcttctctgcagattgggatgcggggaaaaagttcaagtcgccacggtttgtcatgttctgagttagcaaccttggagaaaaccttaaatggaaacgcaatccacttataactataaggtggtgcgccaatttgccatcatgaccgtagtttggggcatagtcggcatgttggtgggcgtcatcattgcggcccagctggtatggcccgagctcaatttcgggccctggttccacttcggccgcctgcgcccgctgcacaccaacgccgtgatcttcgccttcggcggctgcggcctgttcgccacttcctattacgtggtgcagcgcacctgtaacgtccgcctgatttccgacaagctggccgccttcaccttctgggcctggcagctggtcatcgtgctggccgccatcaccctgccgctgggcttcaccttcggcaaggaatacgccgaactcgaatggccgatcaagctgctgatcgccgtcacctgggtggtgtacgcgatcgtgttcttcggcaccatcgccatccgcaaggtcaagcacatctacgtggccaactggttctacggcgccttcatcctggcggtggcgctgctgcacatcgtcaattccgccttcgtgccggtgacgctgtggaagtcctattcggtctactccggcgccgtcgacgcgatggtgcagtggtggtacggccacaacgcggtgggcttcttcctgaccgccgccttcctcggcatgatgtactacttcgtgcccaagcaggccggccgcccggtttactcctaccgcctgtccgtggtgcacttctgggcgctgatcttcacctatatgtgggccggtccgcaccacctgcactacaccgccctgccggactggacccaatcggtcggcatggtgttttcgctggtgctgctggcgccgtcctggggcggcatgatcaacggcatcatgacgctgtccggcgcctggcataagctgcgcaccgacccggtgctgaaattcctggtggtgtcgctgtcgttctacggcatgtccaccttcgaaggcccgatgatgtcgatcaagaccgtcaacgccttgtcccactacaccgactggaccatcggccacgtgcactccggcgcgctgggctgggtgggcttcatcaccatcggctcgatgtactacctgattccgcgcctgttcggccgcgattccatgcacagcgtcaagctgatcgaagcccacttctggctggccaccgtcggcgtggtgctgtacatcgccgcgctgtggatttccggcgtgacccagggcctgatgtggcgcgcgctgaacccggacggcacgctgacctatgccttcgtcgaagcggtgaaagccacctacccctaccacttcgtgcgcttcctgggcggcgccctgtacctgtccggcatgctgctgatggcttacaacaccttccgcaccgtctcctccggccgcgccgtggatgccaagattccggccctcaccgctgaagcccactaagaaggcgaaggaaaaatcatggacaaaatccagaaactgatcgaagaacacgtgggctggctgatcgtgctgaccctgctggtggtaagcgtggcgggcctggtggaaatcctgccgctggcgttccagaaatccgtcaccgagcctgtcgccggcgtcaagccctacaccgcgctgcagctggccggccgcgacatctacgtgcgcgaaggctgctacaactgccactcgcagatgatccgcccgttccgcgccgaaaccgaacgctacggccactactcggtggccggggagtcggtttacgaccacccgttccaatggggctccaagcgcaccggccccgacctcgcccgcgtgggcggccgctattccgacgaatggcaccgcgtgcacctgaacaacccgcgcgacgtggtgccggagtccaatatgccggccttcccatggctggccaaaaacctggtagacgccgaggtgatgccgctgaagatggaggcgctgcgcaaagtgggcgtgccgtacagcgacaaggacatcgccgaggccaaggctcaggtcgagggcaaatccgaaatggatgcgctggtcgcttacctgcaaggcctgggccttgcgctgacgaataagcgctgagccatggactgggttacgttaggacgttcgctgttcaccgtggtctgcttcgcgttcttcatcgtggtgctgatcatcgcctacagcaaacgctccaaaggccgctatgaggaggcagccaacctgcccttcctcgacgacgacaaggtgcaggaagccggccaggagcaggcttccaacggagcaagaaaatgaatcaatacctgagtgatttctggagcatctggatttccgtgatcgtgctggggggattgatctggctgaccctgctggtgttcacccagtccaagaccacggtcaagaagggggaagaagtcgaaatcaccggccacgtctgggatggcgacctggccgagtacaacaatccgctgccgcgctggtggatgctgatgttctacatcacgctgctgttcgccatcgtctacctggtgctgtacccggggctgggcaacttcaagggcctgttcggctggacatcggtggatcagtacacggtggagcgcaacaaggccgaagccaaataccgcccgctgtacgacaagtacctgaaacaggacctgaaaacggtggccgccgacccgcaggcgcaggaaatgggcaaacgcctgttccagacctactgcgtgcagtgccacggcgccgacgcgcgcggcgccaagggcttccccaacctggtgaaccatgactggctgtacggcggcgaaccggccaccatcaagaccaccatcatgggcggccgccacggccagatgccggcctggggcgcgacgctgggcgaggaaaaggtcaaggacgtggccaactacgtgctgtcgatctcggccaaagcccgcaagtacgacgccgaacgcgccagccgcggcaaggaaaccttcgccgcgctgtgctcggtctgccacggcgtggacggcaagggcaagcaggaaatgggcgcgcccaacctgacccacccatccggcagctggctgtacggcggcaccgagaaggccatcatcgaaaccatcaccaatggccgcaacggccagatgcccgcctggaaagacttcctcggcgaaggcaaggtccacctgctggccgcctacgtctggagcctgtccaacaaccccaaagccccgcaataagccgggtctaggcgccgtccgcccgcgcggacggcgtttcccgacccgcctccccacccccagaggctttggcagagcgcatcgcacggtgagcttcgccaagtcctcttcaggaacgcgacatgtcagactcgttgaagaaaatcccgatcaaggttgaaaacagcggccaggacaccgccaccgtctcgctgtacgaggctcagaagaaaatctacccgcgcgcggtcaaaggcgtgttcaacaacctccgcatcctgttcgtcgtcggcacccagctgctgtacctcggcctgccctggctgcaatggaacggccgccaggcggtattcttcgacatggtcggccgcaaattctacctgttcggcctcaccatctggccgcaggacttcgtctatctcgccgcgctgctgatgtgctgcgccttcggcctgtttacctggaccaccatcgccggccggctgtggtgcggctattcctgtccgcaaacggtgtacaccgagatcatgctgtggatagagcaatgggtggagggcgaccgcggcaagcgcatgaagctggacgccgcgccgatgagcctggccaaattccggctgaagttcaccaagcatttcatcatgctggcattctcgctgtggaccggcttcacgctagtcggctatttcacgccgatacgcagcctggtggccgccattcccagcttcggctacggaccgtgggaaaccttctggatgttcttctacggcggcttcacctatctgttcgcggtattcatgcgcgagcaagtgtgcaaatacatgtgcccgtacgcccgtttccagagcgtgatgttcgacgcagacaccctgatcatctcctacgacgaggcccgcggcgaaccgcgcggctcgcgcaagaaaggcgccgatccaaaagagcagggcctgggcgactgcatcaactgcagcatctgcgtgcaggtgtgcccggtgggcatcgatatccgcaacggcctgcaatacgagtgcataggctgcgccgcctgcatcgacgcctgcgacgacgtgatggacaagatgagctacccgcgcggcctgatccgctataccacggaaaacgcgctggaaggcaaatatccggaaaaagccatcccctcgcggctgaaacgcccgcgcgtggtgctgtacagcctggtgttgctcatcatatttaccgccgccatcacctcgctggcgctgcgcaagccgttcaaggtggacatcatccgcgaccgcgcctcgctggtgcgcgaaaccgacgagggctggctggagaacacctatatcgtcaagatcatcaacaccacggaacaaagccagcgcttccgcatcacagccgaaggcctgcccggcatccgcgccaaggcggaaaagccggaaatccgcgtcgacgccacccagaccgaagccgtcaccgtccacgtggaggccgacccgcagtacgcgaccaagggcagccacccgatccgcttcgccatccagtccatcaacaacccttccctgcgcgtggaagagaagtccagcttcatcggagagtaagacatgcaacacaccgcccacccgccccgcccctggtaccgcgaaccctggccgtggatcctgttcggcatcccgctggtctccatcatcgtcggcatcggcttcctcgccgccgccatcaagtcggacgacggcctggtgaccgacgactactacaagaagggcaaggccatcaatatggagctgcggcgcgacaaggccgccgcgcggatggggctgaccgcgcaattgatgctgggcagcgacggccgcagcctgcgcctggtcaccagcagcaaggcgccgctgccagacaccatcgcgctgagcatgatccacccggcgcaggacgactacgacctgtccgccgaaatgacgctggccggccccaatctgtaccagggcatcctgcccaagacgccggtcatcgccaaccactggtacatccagctggaagaccacgccaagacctggcgcatccagggcgagtggaagcccggcgaaggcccgatggtgcagctgggccagcccaagctggagccggccgccaattaagcgccgggcggaccgcccgccagcgggccgtcggcgctcagaccagcgtccttacccggctcagcccgcacaatagcgccgcccccgcctgccagaccgccgtcgccagcatcaaatcccgcagcggcatgtccgccgacagcgcgccgcccaaaaccagcgccagcggcatcagcagcttgaacaaggaaccggtcaggccggacacccggccgatcagcgccgtcggcgtcgcctcctggcggtagctccacacgccgacattgccgcacaccaccgcgaagctctgcagcgccatcgccgccgccagccagcgcagatcgccaagccacgcctgcgccgccatgccggccgcctccaacagcaaagccaggcagatcatccgccccaggcccagcgccttgcgcacccgcgccacgcacaagcccgccgcgatgccgcccgcgccggcgcagccgaacagcagccccaactggccgggcgaaaaacccagctggtcgcgggcgcggaacagaaacaacacctcggcgacgcctgccgcgccattggccagcaccaccacccagctcagctgccacaacgccggattgccgcgcagcgcccgccagccggcggccaattccgccccaaaacgccgctcgccggcctgtccccgccctggcgccggcaccctggccatcagcagcgccgacaacaaaaacatcagcgccggcacgcccaggctccaatgcggacgcgcccaggcgatcaacagtccggacaacaccggaccgctgacggcgaacacgtcgaacaagctgcccagataaccattggcctgcaccagctgcgccggcggcacgctctccttcaccagcgccatccggcagatggcggtcacgtagttgcacagcatcacgcaaaaggtcagcggatagaacagccatgcggccatccagccgccggccagcgccagcgcgcaaacgcccagcagcgcggccatcgccagcaaggcgcgctgcgcccagcggcggcggcatacccggtccacccacacgccgatcaccgccgccagcagcagattgggcaaaaactccaccgcgcgcagattgctcatcgccgccagcgaatgggtcagctcgtacaggatcaagggcagggccagctgatagatctggccgcccagcgccagcagcgcggtggaagcgaacaggccggcgaacaccggctgccgccataaagaaagggaagaaaccgcggacatgcgcgctccatgacatttgacagaagcggcagtatccggcacaaaagcgggaataaaaatggaacaaatcaaaaccattcctccccttttatgcgcctgctccaacactaccagcgactgagcctggcctaccccgcccacgacggcccggcgcggctggccgacatcgccgccgccctgcattgcagcccgcgccacgcccgcgaactgctacagagcatggcggataacggctggctgcgatggcagcccggccaggggcgcggccatgcgtcgcggctgcggctgctggcgccggccagccagcttgaaagggaagcggcgcgcgggttcctggccaacggcgacatcgaaaaagcgatgcggctgctgcccgccgccgcgcgccgccaaatcaccgaattgctgccggcctatctcggcgtcgccccgtccgaaccgcagacgctgcgcctgcccttctaccggccgctgcacagcctggacccggtccagatcaaccgccgcaccgagtgccacctgatccgccagattttcgacggactcacgcgctacgaccgcgcgcgggggcaaatcgtcccggcgctgtctcatcattggcgccatgacggcgaatggcgaaactggcgcttccatctgcgccccggcgtcgttttccacaacggccgcgcgctggatggcgaagacgtccgccagacgctgctgcggctgcgcgacgaggccggcccgcatcagcgcctgttcgcgcatctggctgatgtgaacctgccggcgccgctgaccgtccacatccgcctgacccgccccgatgctttgttgccgcggcggctggccgacagcgccgcctccatcctgccgcgggaatgctggccgcaagccgatttcggccgcttccccatcggcaccggcgcattccggctggaagccaacaacgactatcgcgccacgctgcgcgccttcgaccgccactggaaggaaaggccgctgctggacgcggtggatatctgggtggtggacgatcccgaggtgaaggccaggctggacgcgcgcttctgccatcccggcgaaccgggcggccaaccgtcgctgcgccggctggaggctggctgcagctatctggcggcgaatccggcccggctggactctgttcaacggcgggcgctggccgactggctgcatccggccgtctggcaggccccgctgcccggcgaagcggcgctgggcatgctgccgcaatggcggcaccggccggcgcccatccagccgccggcgcctcggctgccggcgacgctgcggctggccacctaccagttgcccgaccatatcgagctggccgaggcggtggcgcgccggttgcgggacgccggctgccgcatcgagctgacggtgatgccctaccccgacttcgcccgctgcgactggctggacggcgccgacctgctgctaagcggcgaagcgatggccgacgacgtggatttcggcgtctatcaatggctgtgccaggacgccggctaccactgctggctggaagcggcggcccggcacagaatgcgcgcggcggaacaacaactggcgatggagccggacgccgaacggcgctggcagggctatgaggcgctggcgcgcgcgctggtggcggaagccagcctgattccgctgcgccaccatgaacaggcgatggcgttcgcgccgcaattgcaggacgtcacgctggcgcagtgcggctggatggatttcgaccaggcctggctggccgcgccggattgagccgactcagatcgacaggtccgcgtggtagcgcagccagaaagcctcgcggcagccgttgtcgaaactcttgcgcatcggctctatcccgggcgagccgcccagctccaatacttcataggtaatccagctctcggcgcagaccagctcgctggggtaatcgtccacctctatgctgcggcggatcgccacgccgttgtcgaagcggtacacccgctcccgcagcgtcacctcgcagtcggcctcgcgccagctgtcctgcttatcttcgcggccgacgatgcgctcggcgccggcgccgcccatgatcgcccgcgcgtagccggccagcggctcgctcgcgccggccatcaggcgctctccttgcggatgtcggccagcagcggttgcgcgagccggcggtaatcgtcgccgttcagcacgatggacgcgtccagccggccggcgttgaacgcgatctccgaataacgcgccagcagctgcggatccaccaccagccggatgaccgggctgaagctgaacggcggaatcgagccgatcacgcagccggtggccgcttcggcctcggccgcgtccgccagcttcaccttgcgcgcgccgatggcggcggccaccttggcgaaatccacccgttcgtcgccaggcagcaccgccagcacgaattggccggtctgatccgccaccttgcacagcatcgccttggccccctgacccgcctcggtgccgcggacatcggccaccttgcgcgaattgccctcggccggatgctcgatcacccggtagcgggcgcccccagccgtcaacagctgccgcaaacgttcaaacatgcctgccctcccttcgccgggccacgcccggctcattgtccagatgatggtgccggcagctggcatccgcaagccggccgccgcgaaattttgccggcggcctcggccgcggctacactgccaatcaccccgactccagcggtaatcggcatgctcaaactcaatctcggctgcggccacgaccggcgccccggcttcctcaacgtcgactcccaggcggcctgccaccccgatctggtggcggatctggaacagtttccctggccctgggacgacaactcggtggacgagatcctgatgagccatgtgctggaacacctgggcgccagcagcgcaacctatctcggcatcatcaaggagctgtaccgggtatgcgcgcccggcgcgctggtcaccatcatcgtgccgcacccgcgcagcgacaactacctggccgaccccacccatgtgcgccccatcaccgcggccggcctgcacatgttcaaccaggagctgaaccggcaatggatggccgaaggcagctccaacacgccgctcggcgtttacctgggcgtggattgggtgatggagtcatcggacgtgaagattctggagccctgggccacccgcttcaacagcggccaggtcaatgaaggcgacatcagcatggcggtgcagaacttcttcaatgtgataggcgaatgcaccttccacatgcgcatccgcaaacccgccaccgccatttgacaccctcccgcgcgcttgccgcccctcgcccggccatgcatcatgcatgaacggcgcgcgccggctccctctccggccatgtccgctcccgccgcaatctccgcacagaaaggcgccagtccatgtcgaaagagcttgtcttctataccaacccgcaatcgcgggccaatatcgtgcactggatgctggaggaggtgggcgcgccctaccgcccggtgctgctggaatacggcgccgcgatgaaggcgcccgaatacctggccgtcaacccgatgggcaaggtgccggccatccgccatggcgaacagatcgtcaccgaaggcgcggccatctgcgcctatctcgccgacgccttccccgaggccggcctggccccggctccggcggcgcgcggcgactactaccgctggctgtttttcgtcgccagctgcgtcgaacacgcctggaccaaccaggccgccggcttcatccccagcgcggagcagcagcggatgttcggctacggctcctacgaggcgacgatggacaccctggccaaggcggtggccggccgccgctacctggccggcgaccgtttttccgccgccgacgtgtatgtcggccgcaccataggctatggcatcgagttcggcaatatgcgcgacaggccggagctggtcgcctactggaacggcctgaaggatcgccccgccctgctgcgcgccagcgaacaggccgagcgctggcaagcgcagcagccgtaagctttgcccgacggcgacggcctcggccgccgcctctgccaatccgcgctacgccggcctcagccgcgccatgaagtggcgcagtatcggcggctcgtaatcgaacgccagcccgcgcacttcggcggcgcgccgcttcacctccaccaggcagtcggcgatgtagtccatatggtcgttggtgtagacccggcgcggcaccgtcagccgcatcaattcgaacggcgacggctcctgcaagccgctagccgggttgcggcccagcagcaaggaaccgatctccaccgccctcaccccgccctccagatacagctcgcaggccaacgcatgcgccggaaagcgctcggccgggatgtgcggcagcaggcgcgcggcgtcgacgaacaccgcgtgcccgccggtcggggtctggatcggcaccccgccttcgcgcagccgctctcccagatacgccacctggccgatgcggtagccgagaaaggcgtcgtccatcccctcccgcagccctatcgccaatgcctccatgtcgcggccggccaggccgccgtaagtgacgaagccctccatcggcacgcagttcacctgcaccgcgcggaacagcgcctcgtcgtccttgaagcagcacaagccgcccatgttcaccaacgcgtccttcttggccgacatggtgaacatgtcgccatgcgaaaacatctcgcgcacgatggcggcgatgctgctgccggcgtaggccgggtcgcgctcgcggatgaaccaggcgttttcggcgaagcgcgcggcgtcgatgaccagcggaatgccgtgctcgcgcgccagcttccccaccgcgcggatattgtccatcgccaccggctggccgccggcgctgttgcaggtgatggtgacgatgatgccggcgacattggcggcgccctcatcggcgatgatcgccgccaggcgcggcacgtcgaagttgcccttccagtcgtaaggcgcggcggtgtccagcgcttgcggcgtcagcacattgaccgcccgcgcgccggccagctcgacgtgggccttggtggtgtcgaaatgataattggacaggaatagcggccgcgcgccgcggcaacgcttgaccaattccgggaaaaggatctgttcggcgccgcgcccctggtgggtggggatggtgtgggcgtagccgaacaactcccgcacggtgtcggccaggcggaaaaaactgcggctgccggcataggcttcgtcgccggtcatcaggccggcccattgccggtctgacatcgcgccggtgccgctatcggtcagcaggtcgatgtacacgtcttcggagcggagcaaaaagggattccagccggcggcgtccagcgcttggcggcggtattgcggagtggtctggtggatgggctccaccatcttgatgcggtagggctcgggaatgcgtcgtgccatggtgcgtctccttgcgcgggcgcgcggcggcgcgcgcggacatccgcgctgaaaccggggaaaaggggaagaccggcgaaggagcgctcaggcgcgcggaaagtcgaacgtcaggatgatgtcgagggtgtaccaattggggcgcggccccccatgcagggtctgcgccgggcaagcaaagggcggaatattcatcgctgcgccttgggccgttggcggaaaaccggccctaatcgagcgggcctgtcagcccaagatagccgcgccgcgacagacattcaaccgtggaatatcgatacagaaaaggtattgaccaatcaattgtatacagtaaacgatagccatcatgaagaaaaagcatggcaaccaattaaatcgcccaataaaaatcatcaaaaaaacaaggcaaatgctctaattattacaatgtaattaacaattcgctaaaaaaattttcacatctcaacatttagtcgatatgatcgtgcgctgcctacaaaatccaaggcatacataaaaaacaacaacaccgctcgttgaggcgatgtctcaagtcacacaaggaaaaatctctatgtcgacacaatcgcatcccaaggggctctacctgctctttgtgaccgagatgtgggagcgcttcagctactacggcatgcgcgccatcttcacgctctacatgatcaaggctctgctgttcgacaaggcccatgcctcggacatctacggcacctacaccggcctggtctacctgacgccgctggtgggcggctacatcgccgaccgctactggggcaaccgccgctccatcctgctgggcggcgtgctgatggccatcggccagttcatgctgttcttctccggctcgctgcatgagaccaacgtcggcgccgcctcctggctgctgtacggcggcctgggcttcctgatcgccggcaacggcctgttcaagccgaacatctcgtcgatggtgggccagctgtacgcgccgggcgacaaacgcgtcgactccgctttcaccatcttctatatgggcatcaacgccggctcgctgttcgcgccgctggtgtgcggcaccctgggcgacaccggcaacccggccgacttcaagtggggcttcatggccgccggttgcggcatgctgctgtcgctggtcattttcagcctgttcaagaaccagtatctggtgacgccggaaggcaagcctatcggcctggcgccgaagcgccaccacgacagcggcgaaaaagtggtgcacgcgccgctgaccagcatcgagaaacagcgcctggctgtgatcctgatcgtgtccgccttcgtgatcttcttctggtccgccttcgagcaggccggcgcctcgctgaccttcttcgccgaagagcagaccaaccgcaacctgctgggctacaccgttcccgcctcgttcttccagtcgatcaacccgatctcggtggtgctgttcgcgccgctgttcgcctggatctggaccaagctgggcaacaagggcatggaaccctcgtcgccggccaagatggcgctgggcctgttcttcctggccatcggctacctggtgatcgccttcggcgtcgacggcctgcagccgggcgtcaaggtcagcatgctgtggctggtcagcctgtacatgctgcacaccttcggcgaactgagcctgtctcccatcggcctgtcgctggtggtgaaactgtcgccggcccgcttcaccagcctgatgatgggcatctggttcctgtccaacgccgccgccaacaagttcgccggcacgctgtccgagctgtatccggacccggccaagccggtgccgcacttcctcggctacgcggtcaacaatctgcacgatttcttcatgctgttcgtgttcatggccggcgccagctcgctgatcctgttcgcgctgtcctccgtgctgaaaaagatgatgcacggccgccagtaaggtatcgcctgatcgcgccaacgccaccttcgggtggcgttttgcgttccggcgcggggcagacgccgggcccgctctgtgatagccttgcgccggaacaatcgcgctctgaaacaagactctggatgaaaaacgctgcaagctccaattggcggaaacacgccgtttacgcgctgatcgccctgctgttgatacgcctcgcggcgctgtgggccattccgctgaccgacaccaccgaggcgcgctacgccgaaatcgcccgcaagatgctggaaaccggcaactgggtgacgccgctgcacgactacggcgtgccgttctgggccaagccgccgctgtccacctggctgtcggcggccagcatggggctgttcggcgtcaatgaattcgccgcccgcctgccggcgctgctgctggcgctgggcgcgctgtggctgaccgccggcctgatgcgccgccgcggcggcgacgaagccgccaccgccgccgcgctgctgctgggcggcggcctgctgttctacggcgccgccggcaccgtgatgaccgacccatcgctgctgttctgcgtcacgctgagccaggtcgccttctggcatgcgctgcacggcggcggcaaggcctggcgctacgccttcttcgtcggccttgggcttggcctcctggccaaggggccgctggacgtggtgctggtgggcatgcccatcttcttctgggtgctgatccgcaacgaatggaaacggctatggaccgagctgccgtggatctctggcacgctgctggccgccgccatcgccctgccctggtatgtctgggctgaaatccgcaccccgggcttcctcaactacttcatcatgggcgaacacgtcagccgcttcctcgactccggctggaaaggcgacaaatacggcttcgcccacgccaccccgcgcggcatgatctggccctacgccttcggcgcgctgttcccgtggtcgatcgccatgctggcctggctggctagccaggcgcgccggctgccggccatcgtccgcgccggcgagaacgatggctggctgctgtacctctcgctgtggacggtgatgacgctgctgttcttcaccttgtccggcaacatcattttcccgtactcgctgccgatgctgcccggcgcggcactgctgatggccgaattgtggcgccgcggccgtggcgagcgcgccggccgcgcgctgccctggctggcgctgtcgtccggcattctggtgctggccggcatcggcctgcagcgctacgatggcgccaaatacttccgcacccagaaaccggtgatcgccgcttggcagcaacaaagccccgcggccgccgccatcctgatctactgggacagccgccgcgaattctccgccgagttctacagccagggcaaagtacgcaccaccgccaaaccggaggccctggccgccttgcttgccgcccaccccggcagcttcatcgtcaccgagcagcgcgactacgccagcctgccggccgcggtctccgccgcttacgccaaggcggcggaattcccggtgatgaaggaccgcatgctgctgctgcgccccgccgccagccgctgaacgcccaggacagaatcatgactgacacccgcaaacccggcttcgtcccgccttacctgctggaactgcacgcggcggaacgcccgcgcgacccgctggtcagctgcatcatcccggcctacaacgagtcggaaaacatcgtgccgatgctggagacgctgcatcggctgctgacgcagcatggcctgcgccacgaactggtggtggtggacgacggcagccgcgacgacaccgtgcccaaggtgctggaggctggccagcggctgccggtcacgctgatacagctgtcgcgcaacttcggcaaggaaatcgcgctcaccgccggcatcgacaatatcgccggcgacgtggcggtgctgatagacggcgacttccagcacccgccggaaatggtgccggtattcctggaaaaatggcgccaaggctacgatatggtgtacagcgtgcgcgccaaccgcgacaacgaaaccctggccaagcgcgccttcacccgcgtgttctacgcgctgctcaacagcggcgcgccgctgaaaatcccggaaaacacccaggacttccgcgtgctggaccgcagcatcctcgacgcgctgcgccagatgccggagcgcaaccgcttcatgaagggcctgtacaactgggtgggcttcactcagctggcgatggaaaccgaaacccaggagcgccgcgccggcaagagcagcttcaatttccgcagcctgttcggcctgggcctcaccggtctcaccgccttctccaacatgccgctgcggatctggacgctggtgggctgcgtgatttccatgctgtcgataggctacgcgatctgggaattcatccacacgctgctgtacggcaaccgcgtcagcggctggccgacgctggcagtcgccgtcaccttcctcggcggtgtgcagctgttgtcgatcgggatactgggcgaatacgtcggccgcatcttcaatgaagtgaagggccgccccacctacctgatcagccgcatcagcaaaccgcaggccgggcgcggcgcatgagccggcaattgttctggttcggcgtggtaggggtgtcggcgatgctgctgcacttcatgctggtggcgctggtgatggtgccgctggggctgccgcccttggccgccaatgtgctggccttcctggcggccttccagctcagctactggggccaccgccatttcaccttcgaggcgcgccacgtgccgcaccgccaggcgctgccgcgcttcttcggcgtttcctgcctgagcttctgcgtcaacgaggcgatgtatttcctgctgctgcgcttcaccgcgctggattaccggctgtcgctgtgcatcgtgctgttcagcgtggcggtgctcaccttcgtcctcggcaagctgtgggccttcgccgcttctccgcaaacaaattaacgtctggcatgccggatcgctaaactttccggccgccggacggtcgtactgtccatgacaaaacgattgacactctgcgccgacgacttcgcccagtccggcagcatcagcgccggcatcctgcaattgctggacgccggccgcctgtccgccaccagcgtgatgagccagtcgccgcactggccgtcgctggcggccgacctcaaggcccgttcgcagcgcgctgatataggcctgcacttcaatctcacccacagcttcgacgcgccggccaagccgctgtcgcactggctgatgaagagccagctgcgccagttgtcgctgccggcgctgcgcgacgaggcgctggtgcagatcgaccgcttcgccgagcatttcggccggctgcccgacttcgtcgacggccaccagcacgtgcacgcgctgccggtgatacgcgacgcgctgttcgacgcgatacagcggcgctggcaacagctgccgctgccctatctgcgcgcgccggacaagctgggccacccgggcgacaaccgcctcaagtcgctgatcctgcgcagcgtctgcatcaatttcgacgagcaggcgcaggaagccggcttcgccaccacgccgtggttcggcggcatgtattcgctgaccccgcaagcggacttctccggcctgatgcaagcttggctggcgcgcagcccggaacaggcgctgatcatgtgccacccaggcctgccggccagcgacgccgacgatccgatcgccgccagccgcagccgcgaattcgactacctctccggcgacgccttcgccgagcactgccgacagcacaaagtggagatcgtccgcttccagccggccgccgtcgccgccgcctgatcccgcctcacgctcccggccagctcagcgtccacggctcggccagctcagccagcaaggcgcggcaggccagatcggcgaaacgctcgccctgcgatggcggacagacgaagctgaacgcttcgccatccagcgcgaagcgcaaggcgtaggcgtgcagatagccgcgatcggccgcgccgccgccgtacagagcgtcgcccaagatgggcgccccctgcgacttcagcgccacccgcaattggtgggtcttgccggtgcgcgggcgcaataaaaacagccggatccccggctgcaccgaataactgaaaaactgggtgaccgccggattgtcctggctggccagcagccgccaggcgccgccgcggcccttggccatgtcgccgctcaccttgccctgcttcttcagcggcttgcggtcggacagcgccagatagtatttctccacctcgcgcccggccagcgcctcgcccagttgccgcgccgtctcggcggagcgcgccaccaggatcaacccggaagtgatgcggtccagccgatgcaccggccacagcgcgtcgtcgcccaagccggcgcgcagcgcgtccatcaggccgtcctcttcgccttcgcggtggaagctggcgccggcgcgcttgtcgaccaggtagaaacggggatcttggtgtatcagggtatacatggggggcaatcggccgcgggaaaacaaacggcgattgtagagcaggcgccgccgccggaacagcgggcggagcccgccgggatcacgcgatggcgtccttgcgctgctgcatctcgatgcgcagctgcttgcgcatctccgcgccgcggaaacggcgctgctggtccggcgtgtccagcgccagcggcggcaccgccaccgccttgccgtcctcgaacgccaccatggtgaaatagcagctgttggtatggcgctggctgcgctgctggatgttttccgccaccaccttgatgcccacctccatcgaggtgcggccgacatggttgacgctggcgagaaaagtcaccagttcgccgacatggatggcctgcttgaacagcacctggtccaccgacagcgtcaccacataacggccggcgtagcggctggcgcaagcataggccacctggtccagcagcttcagcagcacgccgccgtgcacgttgccggaaaaattggccatgtccggcgtcatcaacaccgacatcaccagttctctttgcccctgggcctgttcattcatggtctgctcccgctgtgtacaagcggacattctgccacgccgattggaatagcgggcaggcgcttctatactgaaacgacagaaggaacgcgtttcatgtccatttccagtgtagccggcggctcttccagctacggaatcagcatgcatggcgccaattgccaatgccccgcctgccaagccctgcgctcgcaggccgccgccgttgcctccgcgccctcctctcccgcccaaaccgccaatgccgcggcgcccgccgccgggggccaggcaggcgcggacgcctccggccagaatggctccggcaacgcgaaaaacgcccagcaagccaatccagccgcgccgaaggcgccggacggcaagccgctgaacgatgcgcaacagaaagaagtggaagacctgaaggcgcgcgataccgacgtgcgccgccatgaggccgcccaccaggccgccggcggcgcgctggccggcgcggccagcttcacctaccaacaaggccccgacggcaaacagtacgcgataggcggcgaagtgcccatccgcctgagccagggcaacacgccgcaggaaaccatacagaacgcccaaacggtgcgggccgccgcgctggcgccgtccgacccctcaggccaggaccgcgcggtggcggccgaagcctcgcagatggaacagcaagcgcggacgcagctgctgcagcagcagaacggcaatcagcatctcagcccgctgcagaaagcccagcaagccgccaccccgggcggcagcccgcaggccaagggcggcaatatcgacacttacgcctgaacccggcgcgccagcctgaggccgttggcgatcacgatcaggctggtgccgacgtcggcgaacaccgccatccacaggctggccaccccggccagcgccaggccgaagaacagcagcttgatgcccagcgcgaccgcgatattggccttcagcacccgcgcggtgcggcgggcgtgggcgatcaggtcggccagccgcgacagcttgtcgtccatcagcgccacgccggcggtttccagcgcgctgtccgaaccggccgctcccatcgcgatgcccaggtcggcgcgcgccagcgccggcgcatcgttgacgccgtcgcccaccatagccaccttgccgccctgctgcagccgctcgatatggcgcaacttgtcctgcggcagcaggccgccgtaagccgcgccgatgccggtttgcctggccaccgcctgtgccacctgcgggctgtcgccgctgagcatcaccgtttccacccccatccgcttcaggcgcgccagggtggccgcggcttccggccgcgcctggtcggccaccgccagcacgcccagcgcctggccgccgtccagcaacaccagcgcgccctcgccggccgcgtccagcgcctgcagcgtctgctccagcagcggcgtcatcgcgccctgctcgtccgccagccggcggctgcccagttgcaaatggcgttccgccacccagccgctgacgccccggcctatcagctcgctcacctggctggcggccggcgcgctcacgccgcgcgccgcggcggcatccagcaccgcgcgcgccagcgggtgggtggaatggccgtccagcgccgccgcccaggccagcacggtgtcttcatcctggccggccagcgccgtcacccgggtgacgcgcggctcgccctgcgtcagcgtgccggtcttgtcgaggcaaaccgtgtcgatgcgggcagccatctccagcggcgcgccgcctttcaccagcaagccgtggcgcgcggccgaagccagcgcgctgaccaccgtcaccggcgtggcgatcaccagcgcgcacgggcaggcgatcaccagcatcaccagcgcgctgtaaatggcctggtgccagggctgcagccccgacagcggcgcggcgacggcgaacagcgctgccaagaccagcaccaccggggtgtagaccgcggcgaagcggtcgatgaagcgctgcgtcggtgccttggacgcctgcgcgtcgcgcacggtggcgatgatgcgcgccagcaccgagccggacgccgacgccgtggtttcgatttccaccacccccgcgccgttgatgctgccggcgaacaccgcatccctgggtcccttgtccaccggcaggctctcgccggtgatgctggcctcgttgaagctgctgtggccgtcggcaatgcggccgtccagcggcacccgctcgcccgggcgcacccgcacccggctgcccaccgccacttcggcggccgccgtttcgcgccagccgccagccgccgccacccaggcggtttccggcgccagcgccatcagcgcgcgcaccgcctcgccggccttggccagcgacatcgcctccagcctttccgcgatggcgaacaggaacaacaccatcgccgcttccggccactggccgatcagcatcgcgccgatcacggcgaccgacatcaggaaatggatgttcagggtgcgggtggacagcgcgatccagcccttcttcaaggtgggaatgccgcccagcagaatggaggccagcgccagcgcggccaccaccggcttgccgtcgcccaggctccaggcggcggcttcggccgcggcggcgctcaggccggataccagcagcagcaggttggcgcggcggccgtggccttgcggcgccagcatcttggcgtcggcttccaactccatcgcctgcatgcccaccttggcgatcgcccgcttcacttcgtccagttgcggcaggtcgtggcgcagcagcaacacccgctcgatgaagttgaactccagcgccaccacgccgtccatgccggccaacgccttttcgatcagcttcgcctcggtcgggcagtccatcgcctggatctgcagccgagagcgcatggcgccgcgtccctggcccaattgcacgcgcgccggggcggcgtgaccatggccatgcgagcagcccgcggcgtgtttgtggtcgtggtcgtgggcatgatcatgcgaatcgccgtgatcgtgggaacacgccgcgccgggctgaggcgcttgcttgccatgatcttggccgcaagcgccaccagcgtggccatgcgtcttgggttccaaagccagcgcggcttcggccttggccgagcagcaatcgccgccgtgggcatgctggcggttctggtgcggtgcagccttgcggtaacgcgtcgcgcttgacatatgcgcctccattgatagtctgggcacattgcacaccctgtagccactacagggtcaagcggattctatcgggaggcatcatgttgatcggggaactagcgcgccagaccggctgcgaagtggaaaccatacgctattacgaacgcgagggactgctgtcggcgccgctgcgctcggcttccggctaccgccgctataccgcggagcagctgggcgaattgaacttcatcctgcactgccgctcgctgggcatgtcgctggccgacatccgcaacctggcggcgttcaaggccgaccaccagcacgattgcgaggacatcaaccagctgatcgatcagcagatcgtcaaggtgcaccagcaagtggaggcgctgcgcctgctggagcagcaattgctggcgctgcgcgacaagtgccatgaaagccatccagccgccgactgcggcattttgcagacactggtggaggctgccgaaggctcgccctgcgtctgccacaccccgttcggccaggacaatcacggccacagccacgattacgaccacgcgggcaaaaaaaacggccgaccccacaagggccggccctaatcaacgctcgtttcggggaggagaaacccaccgaccgccaccccaccgacggccggctcacaacaagaaccgttaaatccaatatccgatcaaaggcgcggcgaacaccgtggccacgccggccagcatcatggtgaggctggccaccacgccctcttccgcgcccagctccgccgccttggccgtgcccgccgcatgggcggcggcgccgaacaaggccccgcgggccaatgccgagcgcaccggcaacaccgccagcatgagctgcccggccatcatgccgaacaccccggtcaccaccacgaacaaggcggtgaggtcggccgagccgcccagcgtgtgcgcagccgccaacgcgaacggcgtgctgatcgaacgcggcgccaggcttttctgcatcatttccgacagatccagccagcgcgccagccacaccgagctgaacaccgccaccggaatcgccaccagcacgccgcagctgagcgacagccagtgcttgcggatcaaggcgcgctgctcgtagatcggtatcgcgaacgccaccgtcgccggccccagcagccaggtcagccagcgggtatcggcgaaataggtgggataaggcacgcgggccagcaccaccaggccgatcaccagcaacggcaccgccagaatcggcgtgctccaccagctgcgggttttcaggtaatactttttcaccagtccgtacaagaccaccgtcagtacgaacgagaccaatgcgatttcatgctccatggacttccgccttcagctgcgccttgcgattgctgccgcgccgccgcaacatcagttccagccggtagcagcggtccaccaccagcgaggtcaccgccatcaccagcatggtggacaggccgatcaccagcactatgcgcaggccggagctcagcaccagctgagggtattgcaccaccgccaccaccgccgggatgaagaacagcagcatctccgccagcagccagcgcgcgccgtgcttgaaccatttcagcggcagcaggccagaccacaatccggccagcaccagcagcatccccagcacgccggccggcatcgccggcagaaagcgctggctcagctggctggccgccagccacaccaggctcagcagcaacacctggctgaaagtctgcagcaagggcgcgaggcggtgaaacaagcggctggccatgatcggcttccatcaaaacttaggagttggtgaaagtatagccagccggcatgcattctaaaaatgaattaaaattatcgacatgattccaaacaggaatggaaatggacatccgcgcgctgcgttattttgtcgaactggtgaaatgccatagcttcaccaaggccgccgacgcgctgttcgtcacccagcccaccatcagcaagatggtgaagcagctggaggaggagctgggcatgccgctgatcctgcgcgaaggccgcagcttccgcctgaccgatgcaggccgcgtcacctacgagcgcggcctggacgtgctgtcggcgatgaaccagctcaaacacgagctggccgacctggcctcgctcagcagcggcgaactggtggtgggcctgccgcccatggtgggcgtggccttcttcgccccggtggtcagccatttccgccgccgctacccgcagatcgagctgaaaatggtggaggacggcgcgctcggcatagaaagtcggatcaagagcggcgacctggaaatcggcgtggcggtgctgccggtggacagccagctgttcgaccattattcggtggtgcgcgacccgctgtgcctggtggcgccggccggctcgcgctggcatggccgctcgctggtgcaactgaccgacatcgccgaccagccgctggtgctgtacccggacgacttcacgctgagccgccgcatcggcgacgccttccgcgagctgggcaagccgctcaacatcgtcggccgcagcgcgcactgggacttcatcgtcgagctggtggcggccaacctgggcatcaccctgctgccgcgctgcatcgtcagccgcctcaacccggagcagtacgacgtgatcccgctgtacgaccccaagttgtactggcacctggcgctgatctggcagcgcggcggctatctgtcgcacgcggcgcgcgcctggctcgcgctgacgcgggatgtgctgggcggacaagagtagcccgcgaccgaatgaaaaatgccgcccgcccgcaagcgggggagcggcatcgcctggcggcaggcgccggatcgaatcagccctgcgccttgaccacgcgctggcggcggctttccgccagcaccatgccggacgataccgacacgttcaggctttcgacggtgccgaacatcgggatcgacaccaacacgtcgcagtgctcgcgcgtcagtcggcgcatgccctcgccttcggcgcccatcacccaggccagcgggccggcggcttcgaaatggtagaggtcggtatcggcttccatcgtggtgccggcgatccacaccccatggtccttcagctcgcgcagcgtgcgcgccagattggtgacggtgatgtaaggcaccacctcggccgcgccgcaggccaccttggagacagtggcgttcagcgtggcggagcggtccttgggggcgatgacggcgtgcgcgcccatcgcgtcggccacccgcaggcaggcgcccagattatgcgggtcggtgacgccgtccaggatcagcaagagcggcggctcggacaggttttccagcacgtcgtccaggtccacgtagttcatgctggcgtctatcatcgccaccacgccttggtggcgggcgttgccgctcatgctgtccaggcgttccttgtcgacgatgtgcagcttgatcttttcctcgccggccttgtccagcaccgccttggcgcgggcgtcgtggcggccgccggccagccagatttccagcaggctcttcgggttctgccacaggcgggcgttgatggcgtggaagccgtgtatcaggcgtttgttgctcatggcggggtctcgattcagaatcccgccattctagcgccaagccgggcccaggcccagcctcacgccggaatgccggccgcctggtcgcgcagctgccagccggcggccagcgccgcgaactcctgcgccggcagcggccggctgaaatgatagccctgcagcgtgtggcagcccttgttctgcaaaaatgccgcctgctcctcgttttccaccccttcggcgacgacgtggaatttcagcttcttggccatcgccagtatcgcctcggcgatggcggcgttgtcctcgtccgccggcaggccgtcgacgaaggactggtctattttcagcgtgtccagcgggaaacgcttcaggtgcgacagcgacgagtagccggtgccgaagtcgtcgatggacagccacacccccagcgccttcagttccgacagcaggctgaccgcctcggtcgggctttgcatgatcatgctctcggtgatttccagctccagccgctccgccgccaggcccgccgcctgcagcgcgccggccaccttggccggcaaggagggttggccgaactggcgcggcgacaggttcaccgccagcctgggcacccgcacgccttctcggtcccaggctgccagctggcggcaggcctcgtgcagcacccagtcgcctatcggcttgatcaggccggtttcctcggccagcgcgataaagcgcaccggcggcaccaggcccagctgcggatggcgccagcggatcaaggcctcggcgccctccagccggcggctgccggcgcccaactgcggctggaagtgcagctcgaactcgccgcgctccagcgccatgcgcaggccgttttccagcagcagccgctcgaaggtctgggtgttcatgccgatgtcgaagaactgataggtgttcttgccggaatccttggcgcggtacatcgccacgtcggcgttcttcagcagcgtgcgcgcgtcctggccgtcgtgcgggaacacgctgatgcctatgctgccggtgatgaacacctcgtgcgcttccaggctcagcggccgccccaattcggccaggatgtcgccggccatctcggccagctgcttgtgcttgtcgaagccgctcatcaacagcgtgaattcgtcgccgcccagccgcgccagcaggccgcgctcgcccaccacccgcgacagccgcagcgcgatctcgcacagcagctggtcgccggcctggtggccgaaagagtcattgatcagcttgaagcggtccaagtcgatgaacatcaccgccagctggccgccttggctggccatctgcgccagcgcctcgtccagcctggcggtgaggctgctgcggttgggcagccgcgtcagcgggtcgtgattggccaggaactgcagccgctcctccgcctccttgcgctgggtgatgtcggaaaacaccgccacgtaattggacagttggccatcttcatcgcgcagcgccgagatcgacagctccgccggataccattcgccgttcttgcgccggtcctgcatctcgccctgccagtggcccagcgtggccaaggcctcctgcatcgcctcgcgttcgcgctggcccaggctgaaaatgcgcgaagcccggcccagcgtctcctcctcggcatagccggtgatgcgggtgaaggcgtcgttgacggcgatgatgcgcgccgccgcatccaggatcaggatgccttcggccgagttttcgaacaccttggccgccagcctgaggttggtgtcggccagcaggcgctcggaaatgtccatcaccacgccgatgatggccttgcgcccctccagctcgaacaggcggctgtgcacctccatgtccaccagcacgccgtcccggcgcagcgcccgggtggagtagtgcatcaccgcgatattgtcgcggaagcggcgcagcacctgctggcgcagccggttggcctcgcccggcgccagcacctggcccatggtcatgcccgtcatctgctcctgctcgtagccgaggatgtcggccagcttgggattgacatagaccagccgctcgtcctgcaggatgtagatgcccaccagcgactgctccaccagcgccagatagcgctcctcggcttcgcgcttggctttctgttcgcgcttgctcagcgtgatgtcggtatcgacgctgcccacgccggccggacggccggcggcgtcgaacagcggaaacttggaggccagcagataggtttccaggccgttcaggctgaaatgctcctcgaactggcgcggcgccagcaagttgagcacctgctggtcctgctcgcggatctgggcggcgtcggcgcggtcgaacacgtcctccgggcgccggcccagcagcgactgcgccgacacgcccacccggcgcgcgtaggcggcgttcaccagcaggtagcggccctccatgtccttcaacgacatcatggtggggctgttgttgaccagcgactcgatccgcgcccggaaggtgcgcagcgtctcttcatccgcgcggtggccgtccatcaggatcgccaccaggaggccggacacgttcagcgccagcgccagcagcagatcggtggaggcgttgcctatgcccggatgcagcggccagtccggcgacagcgccgccagcgacaaggccagtgtcaccatgcccgcggtcagcgcggcgccgcccaggccggtgcggcaggccgcccacaggatgagggggaaaaacagcagctggctgggaatgttcaaggccgcctggctggacagcaacagcatggcgccgcccgccaccaacgccaggatcagcgccagctcgatgcgcagcggcaggaccaagcgttgccgcggcggccaggccagcggcgcgcacaggaacagcgccgaactcgccgccgcccagcactgccaggtccacgaccagggcggcagccgctgcccgcccgccagccacgcgccggcgcccagcagcaacgccaccagcaaagccgggtacgctatcagcgtcagcagcagatgcctcagctcgccgggcgtggccggccgcgcgcgcgcgcgcagcaagccgcccaggcgcaaacccggcagaatcagaaacagcgagccggccagcgccagcgcccacagcggcgaagccgcctcgctggcgatcagcgccgccgccagcggccaccaccagctgcgccgcgcgccgcgggccagcagctgccagcagaacaggccgtgcggcgcgaagctggccaaagacaacacggcctgcggactgcgcggccacagggccaggcaggcggcaaaccccaggaaaaccagcaactcctccacccaaggtgtggctctcacgctccatccttctatttcttgtcgtccggtatgccggatcttgccgatcgccgctccaccgccgccgccgcgcgggcggccgccatggatacattcttatttttgataccacaatggcattacgctttgtatttcttcatgccaaaatacagcgggcttgagccaaacgcatacgatagccgggattcccgccgcccgccagcttccgatcgcaggtaaagcccatgggcatggccggcggactgttataatcgcggcaagctcaacctcgtagaagccagatcaagttggatacgctcccgatcattccgccccgcggccagaaaacccgctgcgttcgcctgccggacgggctggacagccagaccgtcgccgcgctggcgcgccaacgccagccgctgctgatcctcaccgccgacgcccagtccgcgcagcggctgcaggccgagttgcccttcttcgcgccggaactctccatcgcgctgttccccgactgggaaaccctgccctacgaccatttctcgccgcacggcgaactggtcagcgaacggctggcgaccttgtggcagatccgccagcgcgaatgccaggtggtgatcgcgccggtgtccaccgcgctggggcggctggcgccggtgagctacctgctgggccgcaccttcttcctcaaggccggccagcagctggacgtggaaaagctgcgcggcgacatggtcaccgccggctaccagcacgtcacccaggtgatggcgccgggcgaattctcggtgcgcggcagcctgatcgacctctacccgatgggctcgccactgccgtaccggatcgacctgttcgacgccgagatcgacagcctgaaaaccttcgatcccgacacccagcgcacgctgtacccggtgccggaaatccgcctgctgccggcgcgcgagtacccggccgacgaaagcggcgtcaccgctttccgccagcgctaccgcgaaaagatggaaggcgacccaagcaagagccgcgtctacaaggacgtgtcgcagggcctgtggccggccggcatcgaatacttcctgccgctgttcttcgacgaaaccgccaccctgttcgactacctgggcgaggacgcgctgctggtgcttcaccacgacgtgcaggacgcggccgaaaccttctggcgcgacgcgcaaggccgctacgacatggcgcgcggcgatctggaacgccccatcctgccgccggccgacatcttcctgcgcccggacgaattgatggccaggctcaagccctacgcccgcatcgaactgtccgccgacgaagccgcccccggcctcgccctgcccgagctggcggtggaccgccgcgccgacgcgcccttgcaccggttgcaaagctatatcgcccagggcggccgccgcatcctgctggcggcggaaagcctgggccggcgcgaaaccatgctggccttcctggccgacaacggcatcaaaccgacgccggtcgacaactgggccgacttcgccggcggcaaagccgcgctggcgctggccgtcgccccgctctattccggcttcgccctgcccgagcagggcatcgcggtggtgaccgaaagcgagctgtaccagcacgtggcgcgcagccacacccgccgcaaggccaaccgcgccggctccgacgcgatgctgcgcgatctggccgaagtgaaagccggcgacccggtggtgcacgaggcgcacggcatcggtcgctacgtcggcctggtgaccatggatctgggcgaaggcgaaaccgagctgatgcagctggagtacgccgacggcgccacgctgtacgtgccggtgtcccagctgcagctgatctcgcgctacgccggcggcgccaccgacgacatccagttgcaccggctgggcaacccggcctgggaaaaggccaaaaaacgcgcggcggaaaaagcgcgcgacaccgcggccgaactgctcaacctgtacgcgcagcgcgcggcgcgcgagggccacagcttccagctgtcccacgccgactacgccgccttcgccgccggcttcggcttcgaggaaacccccgaccaggccggcgccatcgaggcggtgatccaggacatgtgctccggcaagccgatggataggctggtttgcggcgacgtcggcttcggcaagaccgaggtcgcgctgcgcgccgccttcgtcgcggtgatgggcggcaaacaggtggcggtgctggtgcccaccacgctgttggccgaacagcacttccagaacttctccgaccgcttcgccgactggccggtgcgcatcgccgaactgtcgcgctttcgtagcggcaaggaaaccaaggccgcgctggccggcttggccgacggcagcgtcgacatcgtcatcggcacccacaagctggtgcagccggatatcgaattcaagaacctgggcctggtcatcatcgacgaggaacaccgcttcggcgtgcgccagaaagagcagctgaagcggctgcgcgccaatgtcgacgtattgacgctgaccgccacgccgattccgcgcacgctgtcgatggcgctggaaggcctgcgcgacttctccgccatcaccaccgcccccagccgccggctggcggtgaaaaccttcgtcagcccgctctccaacggcgtgatccgcgaggcggtgctgcgcgagctgaagcgcggcggccaggtgttcttcctgcacaacgaagtcgacaccatcgaaaacatgcgggaaaagctggccgagctgatcccggaagcgcgcatcggcgtcgcccacggccagctgcgcgagcgcgagctggaacaggtgatgcgcgacttcctgcagcagcgcttcaatctgctgctgtgctccaccatcatcgaaaccggcatcgacatccccaacgccaataccatcctgatcaaccgcgccgacaagttcggcctggcgcagctgcaccaactgcgcggccgcgtcggccgctcgcaccaccaggcttacgcctacctgctgacgccggacggcatgacccgcgacgcgcagaagcggctggaggcgatccagctgtccggcgagctgggcgcgggcttttatttggcgatgcacgacctggaaatccgcggcgccggcgaagtgctgggcgaaggccagtccggcgagatgcaggaagtgggtttcagcctgttcaccgaaatgctgaaacaggcggtgcgcgacctgaaaaagggccgcgcgccagatctggatgcccccctgggcgtcaccaccgagatcaatctgcacagcccggcgctgctgccggacgcttactgcccggacgtgcacgaacggctgctgatctacaagcgcctggccagctgcgagaccgaggccgagatcgacggcatccacgaggagctgatcgaccgcttcggcctgccgccgcagagcgtgaagacgctgatcgaaagccaccgcctgcgcctggtggccaaggagctgggcgtgcaaaagctggacgccagcgaggtggcggtgcagatcgccttcatcaagaatccgccgatcgatccggtgaagatcatcatgctgatccagagcaagaagaattaccgcctggccgggcaggacaagttgcgggtggagcagccgctgccggaggtggcgcagcggatcgtgaaggtgaaggaggtgttgaaggagttgagcgcgtaggctcaacgactttcataacgcactcaacaaaaggccacctcggagttggcctttttcctttgcttcaggcgtcccatatcctatttttgctgtaatgaaggtaaatcgctacccaatcaaccctatgccatcctccatccaaattggagtatccttcttgaccatttcagtatcagcctcagccattattaagttatatgaaatgtggagagataggtttcgcattgaaatatcttataacttcagaagtttacctgacattggcaacgacattaccattcgcaacttgtctcccaaatcaatcactctgacacattggagcttgatttatgtttcgggaaaatggccaactcgtcattacacacccatggccagtcctgaatatgatttcaacgatatagaaataaaagcaaactcctcacacacattaacattttctgacattagccactttgactggggagcgacatccttacgaggccgacgcatattcatacgtatatataccgcaggccgcaagccaattactcgcttagtttaccctcaaaattaaaactaataccttctcacgctcttgaatccgctccgcggataatgatttagatgccggttccgcccggcgaacgggtgagggggccgcgcggccagcccctcaccaccccgggccgcccctgcagcccgcgaaaccccgacaaaaaaccgctgggccaggagccgccgaaactacatgcgtgcgaatctttgattcgctcagcagtacgcgctaccgtcgcgcggcgtcgaacaagcggcggcttaaaaccttgcccagcgcttttttgccggcgcgtgctgaaaggggaaggggcgcgtcactcacgctcaacctcttgtagggaggaagcccggcctttccccgcattccaccatccatagccttacctggctttgcctcttgaatttgccttgagccccatgtggcgtaccctctaccaatcgcgtggaaccgaaccgactcgcccttccccatcagcgcaagccggctccgaaaccattcccaaggttttaagccgccggttgttcgacgccgcgcgacgttagcgcgcggctagttccggcggcgccttgggaatggctttggagccggggtttcgcagcgctgctggggtcgcctaggggtgtcggggagctggcgagacagctccctgacctgcccggcgggcagccccgccatgcgaatcatcatccgcgaagcggattccttagcccctcaacttgcgccattgcaaggcaagccctcctctccccggctagattggaaagacaagcacaaggaagaaacgccatgcctcgccacaaccccgacgcggacgacgacgacaagcccgtcccgctgtatcgccaatatgaaacccagggcacggtgcggcagatatcgttttacctgtccgacgagatcggcgccgccatccactacaccgacctcttgtacacgctgcgcaccgccagcagcaccgacatcgtgtttctgcacctgaacaccccgggcggcaatttcgacgccggcctgcagatcatcaacaacatcaccgccagcccggcccacgtggtcaccatcctggaagcgcgcgcctattcgatgggcgcgctgatcttcctcgccggcgacgagctgatcgtccacgacacctgccaattgatgttccacaactactcgtcggcactgataggcaagggcaatgagcaacaggcccaggtgatggccagcggcaagtggttcgagaaggtgatgcgccacatctgccgccccttcctcacagacgaggagctggaccgcatccagaaaggcgaggacatctggctggacagcgacaacatccgccgccgcctcaaccacatccgcaagggcgagccggccgcgcagccgcgcaaaccagccaaacgcggcggccgggcagagccggacgccggctgagccgccttgccttgcctcgggcttgaccgataatcaagacacacccactccggcctgtcttgatgagcgccattcccaagtttgccttcgccgcgctgttggcctgcggcgcagccggctacggcttcgccgagccggacgcggatgcgctcgcgctggtcaccggcgagtttccgccctataccggcgcggccctgccccagggcggcatcagcgcggtgctggtgcgcgaagcctttctggcggctggccagcccgcccccagcatcgttttcctgccctggaagcgagcctattcggaaaccgagcagggccgcttcgccgccagctttccctatgcccgcgatgaaaaccgcgagaaagcctttctgtattccgaaccgctgcatcaggaccgcttctcttacttcgcccgccaggacgacgaggatgcgcgcaagggacgctggcaaggcaagcgcctgtgcctgccgctgggctggaccaccgcctatgtcgacgccgacgtgcgcaaataccaattgcggctggagcggccgccaacgctggaaaactgcctgaaaatgctgaacagcgacaccgtggacctggtgtcctgcaacgacttcgtcgccgattacgcgatgcgccggctattcggcccacacgtgcccttcgccatcgccgatatcggcaaggcgcagagcagcgaactgtacctgatcgtcagccgccgccgccccgacgccgagcggctgatccgccaattcaaccagggcctggcggcgctgcgcgacagcggccgctatcagctgctgctgcggcaataccgcgagcagccccccagccgatgaaaaccctgtccgcccgccttgccagcctgccggttctgacgtgcgccctgctgctgacggcccaggccggcgcggccgaattgcgcgtcgccttttcctccagccggccgccgttttccttccacgacgacaagctgggcgacaccggcatcgaggtggagctgatgcgggcggcgctggagcggatgggctatgcgatgaaaatcatgatcgtgcccaattcgcggctgcggcgcgccgtcgccgccggcagcgcggacatcgcctcggcggtgcacgagcgcggccccgacggcaagggcgtctattattcggacgacttcatcgaataccgcaatgtcgccatcggcaagcagggccggcagctggatatccgctcgctgctggaccttggcggccacagcttcgccatctggcagaacggctggcgcgatctgggccccgtgttccaggccatctaccagcccgacccttccgggcgcttccgccacaactatcacgagagcgccagccaggaaaaccagtgccggatgttctgggccaaccgggtggagctgctgatcatcgaccgcgcggtgttcgactggtttcgcggcaagctcgccgccagcctgcccaccgctgaggccgtcaggtattacgacatcttcccgcaaaccaccggctatccagcggttttccatgaccgcgcgctgcgcgaccgcttcaatctggcgctgcggcaactgcggcaaaacggcgactaccagcgcatcgagcgacgctatcgctccggcgagcgcgactgagccatgtcgaaagcattgcggccgacagtcatcatccatacacttgacatatcactatcccgccccgccatcgccatgccgctacgcaatatccgcatgctggtccgctacagcgcctgggccaaccagcgcctgctgggcgcgctggccgcgctgccggaaaccgaattgctcaaaccgcgcgccaccgtcttcggcaacatactcagcaccctcaaccataatctggtggtggaccgcatctggcaggcccatctgcagggacgcgcgcacggctacgccagccgcaacaccgagcgcacgcccagcctcgccgaactggccgtcgatcaggccgagctggaccgctggtatatcgattacgccgacgcgctggacccggcagcccacgaccaggtggtggatttcgccttcgtcgacggcggcaggggcagcatgcgccgcggcgacatgctgctgcacatcgtcaaccacaagaactaccatcgcggcttcgtcgccgacatgctgtaccagattcccgccctgccgccggccaccgatctaccggtctatctgcgcgatgcccatgatgaggccgagctcctgggctaaagcggttcaaccacccgctcgcgctcgatttccacccggttgcggcccttgtgcttggcctggtacagcagcacatcggcctccagaaacaagctggccaggttggaatgttcgctgggacgcaggcaggccacccctatgctggcgctgatgcgcagcggctggccattcacctggggcgccaggttggcgatggcgccgcgcagccggtcggcggtattgtaggcgtcgatccggccggtctgcggcagcagcaccacgaactcctcgccgccgtgccggcccagcaggtcgccatgccgcgcctctccgcgcaggcagtcggccagctggcgcagcacttcgtcgccggcctgatggccgtggcggtcgttgatgcttttgaaatgatccaggtctatcagcaataatgccaattcagcgcgcttctccagcgcgcgcaggaacaggccttcggccttctcatggaaggcgcggtggttgtacaaccgagtcagcccgtcttgctgggcctgcagccggacctgcagcagcaggcgctcgtaactgatcagcagcatgttgaggctgaagcagaacgtgcaccagaacaatccaaggctgctgaagaggttgaacatcgaccaatgccggccaaaatccggatcgccggcatagcaggccacgctccagcgactggccgaaatcgtcagcatcaccgcggccaagcccatcgccaaccggtggccggccggcgtcccctgcttcctctcctgcagcagcaagcggaaaatcagcccccagtacaacaaatgcgagccggaagtcaccatcacccggcggccatagttctccaccccgccccagtacgcgaacgccgccatcaccagcgccaccgacaaggcggcgtatccccaactgccggagcggcctaacatctgctgcgtggcgatcaacgccagcgggtggaacagcagcagcaacagggtgtcgagcatcagcatcggccagggcggcaaaatcggcggcaggtaggccagcagggttccacacacggcaaacgcgccgcccatgcccagagtcagcagcgcgcgctccttccggttgtataaccagaacaacaccgccacgcccgtcagcatgacggtgtagccggtggtgctgagcaaggtcgccttgaaatccagaatgctttgtatgttttgtatggtttggtttgacatggaggtcgggtgcagcgctgccgccgcgccagcgggctcggcccgccacggcgccgcgggattgtcggccatggaatcgcagacaccatagcagatcgccgccgtcccgcatggcgttgaatgatgccttgcgcatgaaaaaacaggcctagtggcgtcgccgcaacgccgcccgcggccagccggcttgcccaggctgccgcatattggataaaatatccatctcttcaggcgcttgcgcgcggctagcgccgcgccggcccttgccagccacgcggcccctcttaatcggccgcgccagccagcttttcttcccaaaccatcgtccggccgccttggccggcgccgcaggaatccttatgcgctttcgccatttcctgctgcccatggcgttttgcagcgcgccgctggcagccaagaccttgccttcctatgatttcgcgctgcaggccaagccggcggcggcgccgcgcatcaatatggccgcgccggccaagccgctgcaagtccagcccgcgctgcagctgcgcgatctggacgccccgctccagctgacgccgcgccaacagcaggaaatgctgcagcggatggaaaaccggcaaccgcaggcgctgcccggccagccgccgcgcgcgccctgggagcgcccccagccgctgccgcgcttcgacccgcaaaccggcaaaccccgcgccatcccgatgcacgagctgcccaagctgcccggccgctgagcgccacgcgcaagcggccggcgcgctcagcggtcgatcaactgcatgacgtccggcgcgtagcgcgcgccgctggccccgccgtcggcgaacaccgccgccagcgcatcccgctcgccgccatccaggctgacagacaaggctcccaggttgtcgcgcagattggcctgtttgcgcgcgccgggaatcgcgacgatgtcctcgccctgcgccagcagccaggctaacgccagctgcgccgggctgcagcccttgtcggcggccagcgctttcaccttggccaccaggtcgaggttgcgctggaagttttcgccctggaaacgtgggttgtggcggcggaaatcgtcaggcgcgaaatcatccgggctctggatggcgccggtcaaaaatccgcgccccagcgggctgtaggcgaccaagctggcgcccacttcgcggcaagccgccagcgcgccgtcttccggatcccgcgtccacagcgaatattcgctctgcagcgcgtggatgggatggacggcggccgcgcgccgcagcgtggcgggcgaggcttcggacaagcccagatagcgcaccttgccggcgcgcaccaggtcggccatcgcgccgacggtttcctcgatcggcaccgcgggatcgatgcgatgctggtagtaaaggtcgatatgatcgacgcccagccgctgcaggctgccttcgcagctggcgcggacgtattccggccggccgttgacgccgcgcttcatcggatcggccgggtccagcacgatgccgaacttggtggccagcaccacctcgccgcggcggcgggccagcagtttggccaacagccgctcattcgtgtgcgggccgtacatatcggcggtatcgagaaaattgacgcccagatccagcgccgcgtccagcgtcgccagcgactcggcgtcgtcatgcgggccgtaaaaagcgctcatgcccatgcagccgaggcccagcgcggaaacctgcgggccattgcggcccagagtgcgtttttgcatcgccatcgctcctgaagtggaaagtgacatcagcataagggatggccagccgccgataaatgggccaaaatgacaaacattatgtagctgagcttaacaatgtcgcgtccccagcacgatgccctgcaagctttcgccctgatcgcccgcctacgcagcttcacccaagccgccgccgaactgggtgtcaccgcttccgccttgagccagaccatgcgccagctggaggcggagctgggcgtgccgctgctgatccgcaccacccgccaagtcgcgccgaccgaggccggcgacgcgctgctggagcggctggcgccggcgctggagcaaatccgccaggcgctggaggatgcgcgccagctgcagggccagcccgccggcacgctgcggctgacgctgccgcacagcgcggcgcaaatcgcgctctatccccatctggtcggctttcagcgccgccatccggccgtggcgctggagctggacatcagcgacggcctggtcgacatcgtcggccagcgcttcgacgccggcatccgcttcagcgaccgcttgcaacccggcatgcaggcggcgcagatcagccgcccgctccgcttcgtcgcggtggccacgcccgaatacctggcgcgccatggcgcgccgcaaaggccggatgatctgttgcggcacgcctgcataggctaccgcttcggcgccagcgggccgcagtaccgctggcagttcgtcgaggacggccagccgcgccagctggcgctgcgcggcccgctgctcaccaacgacaaccaggcccggctgctgggcgcgcgcggcggcatcggcatcgcctacctggccgaaacgctggtgagggatgacatcaccgccggccggctgctgccggtgctggagtcctacctgccgccggccgaggcgctgtacctgttctacccgcagcagcgccgcctgccggccaggctcagagtgttgatagactttctgcgcgaagccaacggcgtcgtctgaaatgacaaaacccgccaaacggcgggttgcgcgcggcaagcctgaagctagcgcccctgctgcgccagccgccaggcggcatcctgcttgtggtagcccagcaagtagtacaccgccaccaggaacaccagccagccggggccgacgatcagcgccacgcgggtgtccgggaagtaggccatcagggctatcaccagcgccaggaagcccagcgtcaggtaggagccgtacggccacagcggcatgcggtgactgatgccggccagttgctcggccgacagcgaacggcggaagcgcagctgcgccagcaggatgatcagccaggtccacaccgcgccgaaggtcgagatggcggtcagccaggtgaacacctccttcggcgccaggtagttcagcagcacgcccaacagcagcgcggcgatggacagcagcagcgccggcagcggcaccccgcttttcgaaaccttggcgaacagcggcagcgcctgtttctgctcggccaggttgaacagcatgcggccggtgctgtagatgccgctattgcacgaggacagcgcggcggtcagcaccacgaagttgatgatgccggcggcggccggaatgcccaggctctcgaaagtcatcacgaaggggctgccgcgggtgcccagctcgttccacgggtaaatggacaggatcacgaacaaggcgccgatgtagaagatcagaatgcgccagaacaccgaatccaccgcgcgcgccagcgcctttttcggattcttggcctcgccggcggtcaggcccagcatttccacgcccaggtaggcgaacatcaccatctgcaaggacatcagcacgccggagaagccatgcggcatgaagccgccgtgcgcccacagattggcgatgccggtggcgacgccgtgattgccgaagccgaaaataatcatggcgaagccgccggctatcatcagcacgatggtgacgatcttgatcagcgcgaaccagaactcgaattcgccataggccttcaccgcgatcaggttgacgccgcccatcgccagcatcgccgccagcacccagtaccaggacggcacgtccggaaaccagatgcccatgtagacgccgacggcggtgatttccgccatgcaggtcaccagccacaggaaccagtagttccagccggtgaggtagccggccaaggggccgaggtagtcttgcgcgtagcggctgaacgagccggccaccggattgtggatggccatttcgcccagcgcgcgcatgatcatgaaaatggccaggccgccgatgccgtaggccagcatgatggccgggccggccatcttgatcgcggtggccgaccccaggaacaggccgacgcctatcgtcgcgcccagcgccatcaggttgatatgcctctcctccagcccgcggtgcagggtctgttgttctcctggcatgcaatgctccttgtgtaagcgtggaaatcccggttgccgttttgctgttttcttaccggttaatgacaaagcattttacatatattcatatcaatatgaatatttgagcacattaaaaccttgattcaacattttcaagcgcataaaaattcaaaccactcgccataagcgtcaatagaaatgacgcgcatgcctaagcggcggacgcaaaaaagcccggactcgcgtccgggcttggctgatgcggcattccgcgcggcggtcaggccttggctttgctcttgcccttggccggcttggcttccgcggcatcttcctcgcgctcccaggcttccttgtacggccggccgtagaagctgtccagcagcagctgcttcagctcgctgatcagcggatagcgcggattggcgccggtgcactggtcgtcgaaggcggcttcggccagttcatccaccttggccaggaagtccgattcggccacgccggcggcctggatcgacgccgggatgcccaaggtcttcttcagctcatccacccactcgatcaacttttccaccctttcgtggtcgcggctggcttccaggcccaggtggcgggcgatttcggcgtagcgcgccacgctcttcggccggtcgtactggctgaaggcggtttgcttggtcggcacatcggcggcgttgtagcggatcacgttgctgatcagcagcgcattggccaggccgtgcgccaagccgaactcggcgccgatcttgtgcgccatcgagtggcagacgcccaggaaagcgttggcgaaggcgatgccggcgatggtggcggcattgtgcacctgctcgcgcgctttcgggtccttggcgccgttctggtaggacgacggcaggtattccttcagcagcttcaaggcttgcagcgcctgcggatcggagtactcgttggccatcaccgacacatacgcttccagcgcgtgggtcaccgcgtcgatgccgccgaaagcggtcagcgacttgggcatgtccatcaccagattggcgtcgacgatggccatgttcggcgtcaattcgtagtcggcgatcggatacttcacgccggtcacttcatcggtcaccaccgcgaacggagtcacttcggaaccggtgccggaagtcgtcggcaccgccaccatcatggctttttggcccagtttcgggaactggtagatgcgcttgcggatgtccatgaagcgcagcgccaggtcggcgaaatgcacttccggatgctcgtacatcacccacatgatcttggccgcgtccatcggcgagccgccgcctatcgccatgatcacgtccggcttgaaggcgtgggccagatcggtgcccttgcgcaccaccgccagcgtcggatcagccggcacctcgaagaaggtttccacttccaggcccatcttcttcaacaggcggataggctcgtcgacgaagccgttctcgaacagatactggccggtgacgatcaggcagcgtttcttgccggccaggtcttccagcgccaccggcagggagccgcggcggaagtagatggacttcggcagcttgtgccacagcatgttctcggccctcttggcgacggttttcttgttgatcaggtgtttggggccgacgttctcggagatggagttgccgccccaggagccgcaacccagcgtcagcgacggcgccaggctgaagttgtacaagtcgccgatgccgccctgcgaggacggggtgttgatcaggatgcgggcggtcttcatcttgtcgccgaagtagcgcacgcgctcttcctgcaggtcctgatcggtgtacagcgccgaggtgtggccgatgccgcccatggtcaccagcgcggccgccttgtcgcaggcgtcgaggaaatccttcgcgcggtacatggccagggtcggcgacagcttctcgtgggcgaaggcttcgttttcggacacttccgtcacttcgccgatcagcaccttggtggtcggcggcacttcgatgccggccatcgctgcgatcttggccgcgctctggccgacgatggcggcgttcaggctgccgtcctgcaggatcaccttgcgcaccgcctcggcttcgctcttggacagaatgtagccgccgtgcctggagaagcgttcgcgcaccgcgtcgtagatttcatcgacgatgatgaccgactgttcggacgcgcacaccacgccgttgtcgaaggtcttggacatcaggatggaggccacggcgcgcttgatgtcggcggtttcgtctatcaccgccggcgtgttgccagcgccgacgccgatggccggcttgccggaagagtaagccgccttcaccatgcccgggccgccggtggccaggatcaggttgacgtcggggtggtgcatcagctggttggacagcgcgacggacggctcgtctatccaacctatgatgtcttgcggcgcaccggcggcgacggcggcttccagcaccaggcgggcggcttcgcaagtggagcggcgcgcgcgcggatgcggcgagaagatgatgccgttgcgggttttcagcgagatcagcgccttgaagatggcggtggaggtcgggttggtggtgggcacgatgccgcacagcacgcctatcggttcggcgatggtgatggtgccgaaagtgtcatcctcggacagcacgccgcaagtcttctcgtccttgtacttgttgtagatgtattcggaagcgaagtggttcttgatcaccttgtcttccatcacgcccatgccggtttcggccacggccatccgcgccagcgggatgcgtgcgtcggcggctaccagcgcggcgctgcggaaaatgtggtcgacctgctcttgcgtgaactgcgcgaaggcctgctgcgccttcttgacgcgtgccaccagggcgtcgagttcgatttgattgctaacggccatagtgtctctccagaaaccaaatgaaattgccgggcatctatttattcgttttcagctgtttattttcgaaaacgaaaaaattggcagaaaaaccagctgccgacgcgcaaacggcgcggacgccattcaagcttgtgtagcgcggccattacaaggcggctcagataaccttataaaacttggggcttttcaagctttttgccccagcctcgccagactcaccaccatgctagtctgttttcggatattcgtttttgcgcctagccaaacaattgccgcttcgccaacaaaaagagcgccgtttaggcgctccgcaaaatgtcctggtcaaaacatctgtaacgacgatgctaccggcccatgaagccgtacttgaaatactggccgctgcgggtcagctcgcggatgcgcgccggatcggtctcgccgttgatattggtgatcaccagccggccgcggccctgcttcagatcgttgttgtagtcgtaataaccgcccagcaccgccagccggccggcctccacctcgccggaaaacttgaggatggagccttccacctggttgttgatgttgatcagcgcgccgttggttgcgtcgatgcccttgggaatttcgatattgtcgagctcgcgctggatggccggctccatattgctgtaatcgccggcggcggttttgatcgcgccgcagccggtatggctgatgaacatcagcagcggcgtgtgcagatggcggacgccgtactccaccgagccctcggaggtggccagctggttgcccagattgctgatcacgaacagttcgccgtcggcgtcgccgcccagcatgcccacctggccgcccggattggagcaggtcaccaccgtggcgcgcggcgtctggcggccgcccagcttggcgagatagcccggcgaatgcttggcgatataggcgccgttggccttcaatatgctgcccaccacgcttttcacctggccggcctcccctgccgcgaccgtcgccgccgcgcgcgccggatgcctggccttggcgcgcgccttgcgggcggcgtgcggcctgcctcccggcgccgtcacttccggactgggctggctcaggtcgcgcgccggcggtttgcccatcggcaccgacggcgccattttctccggcgccgcctggacgtcagccttggcgccgcccttgcccgcatccatctttttgccagcctccgcgggcttgcccggcttgggcgaattcgcgccggatggcgacgccgactgcggcggcgcggccgcggcgccatccggcgcctgcgccggcttgcccggccgcaacggcagcttgatcacctgctgcacctgcggttccggcgctcccggcgcatcgtccgcccatgcagactgcaacgccagcagcagcggcaacgccatgcacgatctgatatgccgagagttcatgctcgagtccttaaggtcatcaaaggaaatattcattctattctgcatcatcgactatagccggaaaaggcaccagtcggcatgcgccggctcaagcctgcttgcgctggctcagccacaccccggcgaacaccagcacgccggccagaccctgccaggcctcgaagcgctctcccaacagccaccaggccagcaggacggtaaaaaccgggatcagattgttgaaggcgcctgcccgagccactggaatccgcgacaccgcccaggtatagaggccgtaagcgcccagcgtgatgaccgcgcccaggtacagcacccacaagctcggcgccagcagcagccgctgcggccattgcccccatggcgtcagcatcgccaaaccgaaccaggcgctgccggccagcgcctgaatgccggtgatggccagcggcgagtagcgcgtcgacagccgcttggcgatcagcacatagccgcaggcgcacaccatcgcgcaaaactccagcgcgttgcccagcagcgggtccggcgcgcccggaccggagcggctgtccatgctcagccagatcacgccggcgaaagacagcgcgatgcccaaccatacctggcgcggctggcgctcgccgaggaacaggctggcgccgaccgccatcagcatcggcagcgtggcggtgatcactccggcctgcgacgcgctggtataggtcaaggcattggcttcgaacaggaaatacaggcagggttcggccagccccatcgccaacaaccagcgccagtccccgcggcggtagcgccagcggatgcggccgctcatcgccagcggcagcaggcacaggctggcgatcagcatgcgggcgaacagcaccgccagcggatgatagaactggaatacgtatttgagcacgatgaaggcgctggaccacaggaacatggccagcgtcagggcgagataaggcaagatgtctcccgatgcggttggcgggccgtctgcgcggccctatgcggcagacattgtttcagaagaagacggcggctgtcgaacgccgcgtcattccaattgccgcgccagccccatgcggtcggcctgtatccagtactcgacgatcttgccgtccgccacccgatagcaagcgctatccaccaatgccagcggcctgccgctggccgcatggccgtccagctcgcccaaatggcggccaagctgggtccagcgcgcataggcgcggtcgccatccaccagcagttcgtctatccgcagctggaaatcgccgaacaggcgcttgaattcgcgcacgtgctcggcgtaattggccgggctgcgcgccagggtgcgcggattttccgactccagctgatgcgcggcgacgctggtcgccatatagcggctgacggcgtcaggattgacgcccgaacgcacctcctgcaaaaaacccagcaccaccgccctcgtttcctcccgactcatcgccttccctccataaggttgcggatgcgctgcagcgcttccatctcatcccggcagacatgccgggcatggatggccatgccctgccaccaccaatcccgccactgtctgagcatgatcagcaacgtgctcattttcgcctccactgttcaatcattcatcatgaggcatatcgtatacacgctggttttattgaaaaagcccattcgtcatgacacactgttcatgaaatgagaacaaatcacctacccgatgcccaggcgatgctggccttcgacgcgctggtgcggcgcggcagcttcactgcggccgccgaagaattggactgcaccaagagccgggtcagccaactggtgaaagcgctggaaaaagacctgggcagcgtgctggtgctgcgcaacacccgccgcgtggcgctcaccgaggccgggcagcggctggccgcgcacgcgcgcgaattgcgcggtctgctggagcgggcccgcctggatgtcaacgaaaccgagggcgaagtcagcggtccgctggtgatcagctccatcacctccttcgcccaatacctgctggcgcccatactggccgagctggcggtgctgcaccccggcctgcagttgaagctgcaagttgagaaccggctgcaggacccgatagcggaaggcctggacttctgcatccgcacccgcaacgtccatgacgacgcgctggtggccaaaccgctgggcttcgtgcgcgaatgggcgttcgcctcgccggactatctggccaaggcgccgccgctggaagcgccggacgacctgatccaccaccgcatcctgctggacaccagccgccccaagctgcgcgacgcgccggaatggctgctggaaaaggacggcgcgcaaaaactgatccgggtgcagccggtgctgtccagccaccagtacgcgccgctgctgtccggcgccatcgccggcagcggcatcgccctgctgcccccctacgtagcggccgagcacctgaagtccggccggctggcgccggtgctgccgggctggagccacgactgctggccggtattcctggtctacccttaccgccatccgttgccgcgcaaatacgaggccttcatccagcacgtggtgccgcggatgcgcgcgctgctggagaacagccttgatccaggccaaggcggcgcggcggcgccatcgtcagaatgacggccattcgcgccggcgctggcccggcctgacaaggagaactcaatggaacaccgcgacatcgtcatcgtcggcggcggcatggtcggcagcgcgctggcggcggcgctggccggcaacggcctatcgatctgcgtgctggagcgcgaagcgccggcgcccttcgacccggagcaagaccccgacctgcgcgtgtcggccatcagcccggcgtcggcgcgcttcctggccgggataggcgcctgggacaaggtgctggcgatgcgcgccgcgccttaccgccgcatgcaggtgtgggagggggaggaaaaccgcgccgccttgttcgacgccgccgaggccgatgtcgaacaattgggccatatcgtggaaaaccgcgtggcgcagctggccgccaccgcggcgctgcgggacaagggcgatgtcgactaccgctgcccggcggcggtgagcggcatcgtctaccgcccgcaggccacgcaactgacgctgagcgacggcagccaactgcaggcgcggctggtcgtcgccgccgacggcgcgcgctcgctggtgcgcgaggcggccggcatcggcgtcaccggctgggactacccgatgcacgcgctggtgctggcctgccgaaccgatggcggccagcaggacatcacctggcagcgcttcacgccggacggcccgcaagccttcctgccgctgtgcggcgacgctgcctcgctggtgtggtatcaccgcccggaggaagtgaagcgcctgctcgcgctcccggaggcggaattgatcgccgccgtcgcccaggcctttccgcgcaagctgcccggcatcgtccgcatcgcggcgcgcggcagcttcccgctcacccgccgccatgcccagcgctatgtccgcgacggcgtggcgctggccggcgatgccgcccacaccatccacccactggcagggcaaggcgtcaacctgggcttccaggacgccgccgcgctggccgacgtcatcctgtccgcccgcggccaaggcgaggactgggccggcgccgccacgctggcccgctacacccgcgcccgcaagccggccaatctggcgatgcaggcgggcatggacgccttctgctatggtttctccaacgacatcgccccgctcaggctgctgcgcggcctggggctgcggctggccgacaaggccggcccgctcaagcgcggggcgatccgttacgcattgggactggggccgctgcgccgctgaggcctgaagcatcgaggctgtcggccgcgccgcgggcggctccgcttgcgaccacctccgttggaaagcggcctcgatgaaacttcccattctgccggccctgctggcccttgtcctggccggcggcgtccgcgccgatgaaacgctggcgcgcgatctgggcgaagaagtgctgcaattgccggtgcgcctgcccggcggcatccacgccatgaccatcaccgtctaccatccgtccggccccggcccccacccgctggcggtgctcagccacggccgcgccacgaccccggcggagcgcgcccgtccatcccgggtgcgcatgctggacgccgcccgctatttcgtgcgcaaaggcttcgtggtgatcgtgccgacccggcaaggctacggcgccagcgccggcggagcggatccggaagactccggcccctgccgcgacaaggactatgccgactcgctgcgccccgccgtgagcgaaatcctggccgcgctagactacggccgccgcctcgacgaagtggacagccagcgcatgctactgctgggtcaatcggtcggcggcatcagcacggtggccgccgccgccgaaaaccctcctggcgtgatggcggccatcaatttcgccggcggcgccggcggcgacccggccagccatcccggcatcccctgcgccgagccccagctgcggcggctgttcgccgagttcggcgcgcagtcccgcacgccgatgctgtgggtctacacccgcaatgaccacttcttcggcccggaatacacgcaggaatgggcgcgcgcctaccgcgaggcgggcgcccggctggactaccggctgctgccggccttcggcgacaacggccacctgctgttcgccgacggtccggacatctggatgccgctgctggaggcctatctgggcagcctgggctttcgccaacccgacatcccgccgcggccggcgcccagcggcttcgccgcactgaacgacagcgaacgcattccctatctgaagcccgaggacaggcgcgacgcttacgcccgctttctgtccagcccctttccgcgcgccttcgccatcagcccggacggccattggggctatgcccacggcggcgacgccgccggccgggcgctgggcttctgccagaaccatagccccagcccctgctcgctgtacgcggtggaccaggacgtggtgtggccgggcggccagccttgagcggcccggcagcgggccaggcaggcgcatgaagcaaacgggaaagacaggatgttccgcggcggcggcgcgccgtcgccgcgggagggatcaatccagcatcgcgccggattcggatttgggcgagcggcccagcaggccggccaccacctgctgcgggtcgttgccctggtaaagcaggccgcacaccgcggcggtgatgggcatgtccacttccagacgctcggccatggtcagcacttcgcgggcggtggccaccccttcggcgacatggcccagctcgcgcagcgcctgttccagcggcttgccctcggccagtttcaggcccacctggcgattgcgcgacaaggcgccggtgcaggtgaggatcaagtcgcccatgccggacaagcccatcatggtttgcgggctggcgcccagggcgacgcccagccggctgatctcggccaggccgcgggtgatcaacgccgcgcgggcgttcaggccgaaatccaggccgtcggcgacgccggtggcgatcgccatcacgttcttcaccgcgccgcccacctcgacgcccaccaggtcgtcgttggcgtacaggcgcagcagcgggctgtgcagctcgcgcgccacgcgggcggcgaactcggcgtcgtccgacgcgatggtcaccgcggccggcaggccctgcgccacttcgcgggcgaagctggggccggacagcacgccgcagcgatggtcggccggcaactcctccgccaccacctggtgcggcagcaggctggaaccggcctcaaagcccttgcaggcccacaacaccggcggcagcgacttcaaggccttcaacgccttcagcgtgggccgcaggccggccatcggcgtgacgatcagcgccagctccgcgtcctgcagcgcggccgccagatcggcggtcaacgccaagccttcgggaaacggacagtcgggcagataacgccgattgacgcgctcctcgcccatctgcgccgcctggccggcgtcgcgcgcccacagcgtcacctgatggtgacgggcaaaagctatcgccagcgcggttccccaggcgccggctcccaatatcgccagtttcatgccaggcccttataaaccccacaaatcggtaatacgagcatagccgacgctgccgtcgcggtggcgcaccttggcccagccggcctgcggcgcttccatcagctccagcacgccatccttgggcacggtgaacagcagcttgccgtcttcgccggccttgtcgcgcacgccggcctgagtcgacaccaccagcagccagcgctgcttggacagcgccgcggccggaatccaggcgatgccgccggtggcgtcgcgcacgcgcgcccattccttctggctctgcagcacttccaccgggtaatagcggctgaccacgaacagcttcttcgcggacagcgccggcgcctcgtacagtgcgacgccggtttccttgaccgagcggaattccagggcctgggcggcctgggcaacgcccagggccaacagcagcgtaatgacgaggcgcttcatgcgatgcctcaggcgttgccggcttcagcctgctgcgcacgctgctgcatgtacagggcttcgaagttgatcggcgccagcagcaccggcgggaagccggcgcggttcaccacgctggacaccgcttcgcgggcgtacgggaacagaatgttcgggcaagccacgcccaggatcggatccaggtcttcgcccggcacgttgcggatctggaagatgccggattgggcgacttcgcacaggaacatggttttttccggcagcttggcggtcacggtgacggtcagggtcacttcgtagaagccatcgtccagttgctggccggcgctggccagctgcatgtcgatttccggctgagcctgctccaggaatacctgcggcgcgttcggcacctccagcgacaggtcttttacgtagattttctcgatggaaaacgccggttgcagctcttgttgttcgctcatgattctttctcgctaataaccgcctggatgacggttgaattgtttggatacagcggcgggcatcatcgcatgaaagccggcggcggccaaccggcgcggcccgccccggtttcagtcggccagcagcgtgtccagcttgccggcgtggttgagcgcgaccaggtcgtcgcagccgccgacatgggtgtcgccgatgaagatctgcggcacggtgcggcggccggtgatggccatcatcttgtcgcgctgctccgggtccagatcaatgcggatttcctggatgccgctcacgcccttgctcgccagcaactgcttggcgcgcacgcagtacgggcataccgcggtggtgtacatggtaaccggtttcatattcctcgcctgatggggtctgtcggggtcgattatagcctgagtctggcgctcagcggtttgcgctggatcgcgccgccgcgtcgaaagcgccgaccacgtcggccaccaccgcgtccagcgccttggccatctccggcgcgcgcgggctgttgacgatggcgacgatcgccagctggcgcccatccgccgctagccagtagccagccaccgccctcacgtcgcgcagcgtgccggttttcaagcgcagccgcggccccaggccggcgaaacgcttcttcagcgtgccgtcctcgccggcgatgggcaggctggccagaaactcgccggcgtaaggcccgcgcgcggcgtccagcagcacctcgcccatcaggcgggcgcttacccgctcgcgccgcgacaggccggagccgttctccagcgccagcgcgccggcgtcggctatgcccttctgcgccaattgcccgcgcagcgcgcgttcggcggcggcggcggtgtcctcgccgcccgcctcccggcccagcgtcaggaacagcgtgcgcgccatggtgttgttgctgtacttgttggtgtcggacagcgccaccgtcagcggctgcgactgccagaccgccagttcgcgcgcggcggccggggccgtccccagtcccaccgccagcggccccacgccgcccagcgcccgccacagcgcggtgaaatcctggccagcgaagtcatcgtgctccagcacgctgacgaaggcgcgagcgccgtcgcaggccgccggcacgctgccttgcacgccgacatggcggccatcgttgcggatggcgacgaaacggcgcacgtccgggcagggctcgtcgccgccgggcttgagctcggcctgcaggctgacgccggccagcggcgggtccagcaccacccgcgcgcccttgtcgtcgttgtagaaagtcagccaggcgactttcagattggtcaggtggctgtccgcgctcaccatgaaggccttgccggcgtcgccggcgaagtcgtcggcgccgcccacccggctgaacgcgcgcttgtccagcagcagcctgccgtccagctggcggatgccgcgcaggcgcaggctgtacagcaggctcagcagattgccgttgtcgaagcgcggatcgccgcctcccagccaatacaaatcgcctttcagcgtgtcgccccgcaccggcgcttcggacagcagcgccgtcttccagcggtagtccggccccaattggttcagcgccgcccagccggtgagcagcttcatggtggaggccggattcaccgcctggtcggcgcggtattcggccaccgggctgccgccttccaccggcgcggcccacaccgcgatctcatccggctggaagccatgcaggtccagcgcctggaccggcgcggcgctggccgtcaaagcagccagcagaatcagtttacccgtcatgttcacctcataattcctgcggatcgacatccagcgaccagcgcaagccgcggccatggcagcgcgccagcgggtcgagcaaggcttgcgcctgcgcgagcaggctgtgcagcgcggcgcggcgcggcgcctccagcaccagctgcgcgcgctcgcgctgcgccagccgcgccatcaacgccggcgccgggccggaaatcaatacgccgtcggccaagggctccagcagcgcgcgcgcctccttgagaaaggcggcggcctgcgccaactccgggctgtcggcgcgcagcagcgcctggaacacgctgggcgggaagccggcctggcggcgctcgtccagcaggctggaggcgtaaccgtcgaagtcatgcgccgccaacgcctggtacagcggatgctcgggccattgcgtctggatcagcacctcgcccggcgcttcggcgcggccggcgcgccccgccacctgcatcaactgcgaaaacaggcgctcggaagcgcggaagtcggccgaatacaggccgccgtcagcccccagcaccgccaccagcgacagggtgccgaaatcgtggcccttggccagcatctgggtgccgaccaggatgtccacctcgccgccatgcaccttgcggtacacctcgtcccaggcgtccttgcggctggtggtgtcgcggtctatccgcagcacccgcgcctccggcagcatccgctgcagcgccgcctccagcctttgcgtgccctcgcccagcggcttgatgtcggggtcgccgcaatccgggcaggcgcgcggcaccggctcttcccagccgcaatggtggcagcgcagcttgcgctccagcaaatgcaccaccagcttggccgagcaatgcgggcagccgcttagccagccgcaagcggtgcaggccaccaccggggcgaagccgcggcggttgatgaacaccaggctcatctcgcgccgcgcgagccgcgcccgcaacgcctcgaccacgccttcgtctaggccctcggccagacgccggcgccgggtgtccaccagccgcacgtccggcatccgcgccgcgccgtgggcgcgccggatcagcgccagcttgcggtaacggccggcctcgacattggccactgtttccaggcagggagtagccgagcccagcacgatggaaatgccggcgcggcgcgcgcgccacaccgccagatcgcgcgcgtggtagcgcaggccgtcctgctgcttgaacgagccgtcgtgctcctcgtccaccacgatcaagcccagcctgggcagcggcgtgaacaccgacagccgggtgcctatcaccacctcggcgtcgccatgccaggcgtccagccagccgtgcatccgttcgccatcggccaggtggctgtgctgcaccacgatgcggctgccgggaaagcggtcggcgaaacggttgatcagctgcggcgtcagattgatttccggcaccagcaccagcacctgccgccgcgcggcaagatgatcggcgatcagctgcagatagacttcggtcttgccgctgccggtcacgccgtgcaacagccagggctgaaaaccttggctggcgcgcagcgcgtccagcgccgcctgctgctcggcgttcagcgccggcgcttcgcccagccgcagcggcgccggctccggcgtcgcgcgcgccgccttgccctcggccagccaatcggccagcagcttgccggcctgcggcgtcaccgccttggccgcggccaggtccagcggcccgtcctgcagcgcctgccacaacgccagcctggcccgctgccgcgccggcggcgcctcggccaagcccgcggcggtcaggaggaatgaccggcggtcggggcggatgacgtcgcgcggctcgcgcaagccggtgggcagcgcggtgaacagcgtaggtcccagcggatagtgataatagccggaggcgaagcgcgccagcgccagaaactcttccggcagcgccggcagtccgtcgagcacgctttcgatgcatcgcagcttggcggcgtcgacctcggcgacaccctcccccggtatcggcgcgacaaccacgccacacacccgccgattgccgaagggtacgcagactctcgcgcccgccatgacgggtgattgagtcaggtaactgaacgttccgggcaatggcagatccaccaccacctggaccaagtccttgccatccatttacatgccttcctcaggcaaaccctgctgcgacaaggctttgcatccgctgtgcacagatcttgtggataactttgtgaacaaccatgctgatcgctggcaaaaagccatgaaatcagtgtttccgttggattgcacaaaaattaatcaaatgtaaaactcttttattttcaatggtttataaagttatttattttttgccttgcgcgcttgacaagagaagccacagcgactaggccgtgtgcataacttcagaaacaccagccgcgtccgctgtcaatagacatttttcaagttgcaaatatccatctaaaaacagaaacgaaagccggtctgacgggcgtcgataccctggcggccgcccaaggcttcgatacgacaagcgcaataaattcttaaaaaaccgcggtttttttccacaggttttctgcataaaagataagaattctgtttaaacagaaacaagaattcattcagcaacatccgcgcgcaccacgctggtgcgccgcgcaccgggcgcggcaccagcatagtccgggatctcactgggaatgataggggcgcgacagccggtgcaccgcctcgatcagcgcgccggcgtgggccgggtcgacgaactgcgagatgccgtggcccagattgaacacgtggccgctgccctggccgtagctggccaggatccgccccgcttcgcgctcgatggcttccggcgaggcgaacaaggcgttgggatcgaagttgccttgcagcgccaccttggcgccgacgcgcgcgcgcgccaggccgatgtcggtggtccagtccaggccgacgcagtcggcgccgatgccggcgatgtcttccagccactggccgccgttcttggtgaacacgatcaccggcacgcgccggccgtcggcctcgcgcttgaggccggcgacgatgcgctgcatgtaggagagggagaattcgcgataggcggcatggctgagcgcgccgccccaggtgtcgaaaatctgcaccgcctgcgcgccggcgtcgatctgcgcgttcagataggcgatcaccgactgggtattcatttccaggatgtggtgcagcagctccggacggctgtacagcatcgccttcacatggcggaagtcatccgagccgccgccttccaccatatagcaggccagcgtgaacgggctgccggaaaagccgatcaagggcacgcggccgttcagcgcctggcggatgctggccaccgcgtcgaacacgtagcgcagcttgtcgagcggcgccgggcgcaacgcgcggatggcggcttcgtcgcgcagcgggcgctcgaacttcggcccctcgccttcggcgaaatacaggcccaggcccatcgcgtcgggcacggtgaggatgtcggaaaacaagatcgccgcgtccagcggaaaacggtccagcggctgcagcgtcacttcggtggcgaaggccgggctggtgcacaagtccatgaagctgccggcgcgcgcgcggctggcgcggtattccggcaggtagcggccggcctggcgcatcatccagatcggggtgtattcaaccggctccttcaagagggcccgcaggaaggtatcgttgctcagctgggtcatgtcggcacacgctatgggaatcagccggcattatacccacccggcctcaggggtgaaaccacagctcgcgccgccgcagcggcgtgtcctccggcagcagcgggttgtccagttcgatgatggtgcgcgccgccagattgagtccgcgcagatgatcgccgttgaaagacttgaacagctgctcgaaactgccgtcggcgacgctcctctccaggccctgctccagcatcctggccaactccgggcgcttcggcgagacgaagaaataaaaggcggtggggtagtgcagcagcaggtaggggtccagcatcagccccttgctgttcggcgactccagctcctgccgcacctcgatcacactgcgcggaaagtagtcgtagcggcgctggcgcagcatggagaacaggttgggataatcgacgctggtcaccaccggcaggccggcatgctgcaggatctgggtgtccggccagtcctgtccctgcccggcgcgaaacgccatcaattgctgccgggttttcacgcccttgaacagctgcggccggtcggcgctgatcagcggcacccgccagcctatcagccccttgtccagcggcaccttcaccgccagcaacttgctttcgcgctcgcggctggtcatcccccagaacaagtcgacgctgccgccggcacgcagcatctgctcggtggcgcgcccctggttcatgtcgcgcgccgccaagagcacgcaacgctcgcgcatctggctgcaggccaactgcaacagcgcctgcatgtagggccagtgcgggtcgttgtcgccggacaccagcgcgtagttgatggacatgccagccgcctgcgccatcggcagcaggcagcacagcagccatatgctcaacaccctcaccatgatggaagcaccccgtcgccccgatgcctccattatggccgcggatcagagccagcccaagccgcccgccagcccgcccagcagcagcagccacagcggattccagttgcgccgccaggcgatccaggccaccgccaggctcacgccccagccggcggcgtcgcggttggccgcctgtagcaacaggcaggcgctggcgccgaccaggcccaccgtcagaggcagcaaggcgcgcgccagcagccgggccagttcgccgccctggttggcctcccaccagcgggagacatagaagctcagcagcgacgacggcagacacatgcccagcatgcagaccagcgccccggccaggccggccacatgccagcctatcaggctgaccaccagcacattggggcccggcgcggcctgggcgatggcgaacagctcggcgaactggccggcgctcatccagccctcggccaccaccagccgctgcagctcaggcaacagcacattggcgccgcccaccgccagcagcgacatcaggctgaaatgccacagcagcaccaacagaatcatgtcgccgccctccctctgttcagccacgccagcgccagcgccaacggcgccgaggccagcagcacccacagcaaaggcaggcggaacaccgcgatggcggcgaaggtggcggccaccaccagcgcgctccagacacgccgctccagcctggacagcaaacgcagcgccatcgccagtaacaggccggcggcggccgccgccaggccatgcatcacatgctccaccagcggcagctggcggtagcggccgtaaacggaagccaacaacagtacgatgaccatgggcgccaacagcaggccgcacaccgccgccagcgcgccgctcggcccgtggaagcgcgcgcctatcgacaccgccatattgacgatattgggaccgggcagcacctggcacagccccagctgctcggcgaagtcggcctcggacagccagcgccgcttcagcaccagcatgctgtgcgcctgcggcagcacgccgccgaaaccgctgacgccgatggagaagaagccggcgaacagctcgcgccggctgggaagaatcagatcgctattcatgccttgacactactcgccgccgcaggactatacaaacgagaaattctgacaggggcggtcacctgccctcacagttcgcccagccgctcggctatgaaatcgacgaaaacccgcagcttgggcaagggttggcggtcggccgggtaaatcaggtgcatgggcttgggatcgggcagatagccgtccagcagcgacaccagcctgccctccgccacatccccggccaataacgcctccgcctgcagcgcgatgcctgcgccggagagcgccagctggcgcaaagcctggccctgattgcacaggaagcggctggcgcgcatccgcaggccatgccgctgcgccagcgcctcccagccgtcgtcgcgccgccagcggctgaagcccaggcagtcgtgctccgccagatcggccggcgtcgccggcgtgccgcgcgcggccagataggcgggcgaggcggcgatcatcatccggtacggccgcaaacgccgcgccaccatgccggaatcggccagatggccgatgcggaacaccgcgtcatagccgtcggccaccagatccaccagctggtcgctcagttccagctccaccccgatatccggatagcgcgccatgaaatcggccaacagcggcgccagcctcagcgtgccgaacgtaaccgaggcattgatccgcagcaccccgcgcggctgcgcccgcagcagcgccgccgcgtcctcggccgccgccaattcggccaggatggcgcggcagcgttgaaagtaatgctggcccagctcggtcaactgctgccggcgcgtggtccgcaccagcagcttgccgcccagccgcgcctccaaagccgcgatatgcttgccgaccatgggctgggacaaccggtgggcgtcggccgccgcggtgaagctgcccttctccaccaccgcgacgaacaattccatgctgagcagtcggtccacgagattagaaactccaagttatcaattttgttcatcatagcggattaatcaaaccagcgaatccatgcacactgcggacatcgcaacccataacggagaacatccatgaagattctgctcgtaggcgccagcggcacgctgggccgcgccgtgcatcaagcgctgtcccaccatcaagtcatcaccgccggccgcggcagcggcgacctgcgcgtcgacatcaccgacagcgccagcgtgcagtggatgttcgagcaggccggccgcctcgacgccatcgtcagcgccaccggcagcgtgcacttcgccccgctggccgagatgactgccgccgacttccgcatcggcctgaacgacaagctgctgggccagatcgacctggcgctgaccggccagcattatctgaatgacggcggctccatcaccctgaccagcggcatcatcagcgcccaacccatccgccagggcgccaacgccaccgcggtcaaccgcgcgctggaaggcttcgccgccgccgctgcgctggagctgggccgcgaccgccgcatcaatgtggtcagccccaacgcgctgcaagagtcctgggacggctacgcgcccttcttccccggcttcgagccggtgccggccgcgcgcgcggcgctggcctatgtgcgcagcgtggagggcatcgccaacagccagacgctgaccgtgtggtgattccccaaaccagggcaggagacaggccatgaagatactgctagtcggcgccggcggaaccataggacgttccgtgtcgcaagcgctgtcacatcatcaagtcatcgcagccagccgcagcggcggggaggtccgcgtcgacctctccgagccgtccagcatccgcgcgctgtttgaacgcatcggcaaggtggacgccatcgtcagcgcggccggcagcctgcacttgggctcgctgaccgaaatgtcgtccgagcagttccgcatcggcctggacggcaaattgctggggcaggtgaacctggccctgatcggccagcactttctcagcgatggcggttcgatcacgctgaccagcggcatgggcaatgaaataccgatccgacacggcagcaacgcctgcgccgtcaatgccgcgatagaaggcttcgtccggggtgccgcagtggagctggcagccggccaaaggatcaacgtcgtcagccccggcgttttgcaagagtcctgggaagctctgaaggacttattccccggcttcgaggccgtgccggccgccagagccgcgcgcgcctatcaacgcagcgtcgaaggcgtggagaccggacaagtcttcaaggtctggtaaggcccggcgcgcggccaacctatactgcaacagccgccaaacaccggacgccgcgatgaaagctatcctgtggggcgggctggcgctgctgctatgcccgctctttccccatgccgagccgataccggcgtacagccaggcgatagagccctggggcgatccggccagcggcgacggcctgacgccgcgctttctcggctggctggccgcgcaaagcgggctgcggctggcgcaggacacccggccgctgccgcgcctggtggaagacctgaaagccggccgcgacgcgctggcgctgatcaccgcctcgccggagcgcgacgccttcggcctggagctgtgtcgtcccgccgccatccggctgtcgctgatccaccgccaggccagccgcccgctgcggcccgaggacttccggcgacgaccggtgggcatactgcgcggcacccatacgctggacgcctttctgacggcttccgccgccgccccggtgcgggtggccgacatgcgccagggcttcggcatgctgcgcatcggccggctggacgcgatgatgtgcgtgcggcccggctgcggccgcgtgctgcgcgaactgtcctcccccgccgacaaatggaccgaattgccgatcagcagcgagccgatggcggtatacgtgtcgcgcgcccacccgctggcgcgcgatgcggcgacgctggaaaaactgcgcgcggcctgcgtttccgccgccggccggcgcgagatggcggcgctgctggcgcgctacgattagccatgaaaaaacccgccggccttcgcaggcgggcgggtctgccgggcatcggcacggaccggatcagatgtcggcctcgacctcgttgcccttggcttccatccagctgcggcggctggccgcctcgcccttgcccatcagcatcacgaaagtgtccagcgtctgctgcagctggccctcgcgcacccgcacctggctcagccggcgggtgtccgggttcatcgtggtgtccttcagctgctccggattcatctcgcccaggcctttgaagcgcgaaatgctccaggcgttctcgcgcacgccttcgctgcgcaggcggtcgaggatggccgccatttcgccttcgtccagcgcgtacagcttgcgcggcggccgggtcttgccctggcccggcacgtcgacgcggaacagcggcggctgcgcgatgtagacattgccgttctccaccagccgcgggaaatggcggaagaacagcgtcagcagcagcacctggatgtgcgagccgtcgacgtcggcgtcggacaggatggcgatcttgccgtagcgctggccggacaagtccggcgcgtcgttcgggccatgcgggtcgacgcctatcgccacggaaatgtcgtggatttcggcattggagaacagctggtccttgtccgtctcccagctgttgagcaccttgccgcgcagcggcaggatggcttggtactccttgtcgcgcgctagcttggccgagccgccggcggagtcgccctctaccaggaacagctcgttgcgctcgatgtcctcgctctcgcaatcggtcagcttgcccggcagcacggccacgccggaacccttcttcttctccaccttcttgaccgacttcagacggctctgcgcctggcggatcgccagctcggcgattttcttgccggcttccacgtgctggttcagccacagctccaccggatcgcgggcaaggccggaaatcagcttcagcgcgtcgcggctggtcagcttgtccttggtctggccctggaactgcgggtccagcacccgggccgacagcacgaagcgcacgcggctccacacgtcctccgccatcagcttgacgccgcgcggcaacaggttgtggtgatcgacgaagctcttcaccgcgtcgaacacgccggcgcgcaagccggcctcgtgggtgccgcccaccggggtggggatcaggttgacgtagctctcgccgctggcgccgtcctcgaaccaggccatggcccactgcgcgccctcgcccttggcgaattgctcgtggtcgtctccgatatacgcttcgccggcgaacagcggcgccaccggctcgtcgtcgccgcacagctccgccagatagctcttcaggccttccgggtactgccacaccttcacctcgtcgccgctggacttttccaccgtcagcgtcaccgccacgccgggcagcaataccgccttggcgcgcagcaggcgctccagctcctgcatcgaatagcgcgggctttcgaaatatttgccgtccggccacacccgcacccgggtgccgctggtgcgcgggccgcagtcgccgatgcgggccaagggttcgatcacatcgccgcccgagaacaccaggcgatgcacgccgccctcgcgcttgacctccacttccaggcgggtggacagcgcgttggtcaccgacacgcctacgccgtgcaggccgccggaaaaggcgtaggcgccgccgtccttcttgttgaacttgccgccggcgtgcagccgggtgaacaccagttccaccaccggcacgccttcttgcggatgcaggcccaccggaatgccgcggccatcgtcctccaccgtcagcgagccgtcctgatgcacggtgacggcgatcttgcgcgcgtagccgcccagcgcctcgtcggcggcgttgtctatcacttcctggcagatgtgggtggggtcggtggtgcgggtgtacatgccgggccgctctttcaccggctccagccccttcagcacccgtaccgaggattcgtcgtattgttggctcatattcttggtcttgctttatccgcgactcgcgcctgcgccgctccggcaagagcggcgggaaaaaagacagcgggcatcggcccgccgtgtgggtatagctgaaacggcgccgccgtcaatgctcgctctgcgcgccggtgcgcgcctggtaggcgtggtggctctccacgccgcgcaaaaagcgcgacaattccgacagcgcccgctcgtacacgtcgcgcttgaattcgatcaccgcgtccaccggcgcccagtaatcattccagcgccagccatcgaactccggatggctggtggcgcgcaggcagacgtcgctgtcgcgcccgaccagccgcaacagaaaccagatctgcttctggcccttgtaactgccgcgccattcgcggcgtacccaattcgtcggcacctcgtaacgcatccagtcgcgggtgcgtcccaggatcttcacgtgctgaggcagcaagcccacctcctccagcagctcgcggtacatcgccgcttccgggctttcgcccggcttgatgccgccttgcggaaactgccaagagtgttcgcgcacgcgcttgccccagaacacctcattcctggagttggtgaggatgattccgacatttgggcggtatccgtcccggtccagcatggaaaaaacctgcaattcgtctagttaccggaatttttgcacatttccgtctgccttgccatgcgcgaaactccggcccgccgacactttaaaaacttgagcgccgccgcccgcgcgccgccgtctcccccaaaccagccaaacggtgctacgatgcgtcgattgaacgtcattcaactgcgcattcatggcatttctgcttacccgaccaacgctttcccgtctgccctggctgcctctgcggccggaagacttctccacgctgctgcaaactagcgagttccgcctgcgcctgctggccggcatcgccgccgccgagcaacgcatctatctgtgctcgctctacctggagaacgaggaagccggccgcgaaatactggacgccctctaccaagccaagcagcgccgcccaagcctggacatccgggtgatggtggactggcaccgcgcccagcgcggcaggatcggcgaagaccagtcgcactgcaacgccgcctggtatcgcgacgaggcggcgcgccgggagctggacatcccgatctacggcgtgccggtgcaaacccgcgagctgttcggcgtgctgcacctgaagggcttcgtcatcgacgataccgtctactacagcggcgccagcctcaacaatgtctacctgcacaagctggacaaataccgtttcgaccgctaccacctgatccgcaatccggagctggccgacgcgatggccggcttcatggccgaacagttcttcaacgacccggcggtgttccgcctggacaagccggcgccgtccacccgcagcatacgcaaggaaatccgccagctgcgcgacaagctggtgcatagccaataccggctggccggcggccaggcggcgcccgatcagcttagcgtcagccccatcgtcggcataggcaagggcaaccgcctgaaccgcgccatcctggacgtcatcgccagcaccgagcgcaagcttttcatctgcacgccctatttcaacttcccccgctcggtggtgctggaaatcaaccgcgcgctgcgccgcggcgtggagatcgacatcgtggtcggcgacaagaccgccaacgatttctacatcccgcccaaacagccgttccgggtgatcggcgctctgccttatttgtacgagatgaacctgcgccgcttcgccaagcgccagcgccagttcgtcaaccgcggcgaactgcgcgtccacctgtggaaggacggcgacaacaccttccacctcaagggcatgtggggcgacgagcgctacatcctgctgaccggcaacaacctcaatccgcgcgccttccggctggatctggaaaacgccttgctgctgcgcgatccgcagcgccagctgcaggctcagagccaggccgaacaacaaagcatcctgcgccacaccaccttgctcaagcactatcgccagctggaagacgtccgccactacccggaacagatcaagaagctgctgacccgcctgagccgggtgcggatagaccgcatgctgaacctgatgctgtaagaccttgcttcccagccccgccgccgcggggctttttcattgcccaacgccgcgccgccatatgctaaaactactaagcatatgcacgcagcggagttgccgcatggccacccccaaggtagaaacccgcaatctagacgtcagccacgattacgcggaaaaatggcagcaagtgctggacctgctggccaggatagtcagcattccggcggcattgatcatgcaggtgcagccgccgcgcatcaaggtcttcctctccagccacagcgccggcaacccctacgaggaagacgaaatggccgacctcggcaccggcctgtactgcgaaaccgtgatgagctcccgcaacgagctgaccgtgcccaatgcgctgaccgatccggactggtgcgacaaccccgatatcaagctgggcatgatctcctatatgggcatgccgctgacctggccgaatcaggacatcttcggcaccatctgcatactcgaccgcgtcgaaaacgcctacacccccatctaccggcagctgctggcgcagttccgcagcatggtggagcgcgacctcaagcagatctacaacgacaaggcccgcgcgcaggaagacgccgccctgcgcgccgacgaggccgagcgggtgcgccgcgagttcgaactgctgcgcgccggcgagcagaaagccttgcgcgcgctgcgcgagagcgaggagcgctggcacttcgcgctggaaggcgccggcgacggcgtctgggactggaacatcgccaatggcgaaatctttttctccagccgctgccagcaactcttgggcttgtcgcggccggccgacatcgccgatttccagctctggcaaaccggcatccaccccgacgacctgccgaccgtgctggccgacctggccagctatctgcgccaaccccagggttccttcgtcaccgagcatcgcttccgcaaggaccaggactggatctggctgctgggccgcggcatggtggtcagccacgacgcccaaggccagccgctgcgaatgataggcacctactccgacatcagccgccgcaagcacgcggaaggcgagctgcagctattgaacagccatctggaagaacgggtggccagccgcaccgccgagctgaagaaagcgatgcaccaaatcagcatcgccgaaaagcagacggcgctggcccggatggtggcaggcatggcgcacgagctcaacaccccgataggcaacatccttctatgctcgtcgcagatccaggccgacgtggccgacatcgcccgcgccgacgccgacaagcagctgtcgcgcaagggactgcaggatttcctgctgaaggccggcgaaacctgtgaactgttgcaacgcaacagcgaacaggccggcgatctgatcggccgcttcaagcagattgccgtcgaccagctggaccagcccaaacgcgtgttcagccccggcgaagtcatcggccagctgctgaaagcgctgctgccgcccgagcatcacccgcatctgctggtggagatgcacgcgccggcccacctgatgatagaaaattatcccagcgcgctggagcagctggtttcgcacctggtcgccaactcgctgacccacggcttcgaagggcgcaaccagggctgcatagccatcaccatcagccaatcgcagggcgacatcacgctgcgctacgaggacgacggcaaaggcattccggcggagttgcacggcaaggtgttcgatccctttttcaccacccgcatggggcaaggcggcgtggggctgggcctggcgatggtgcacaatatcgtgcaggtgatcctgaagggacagatccggctggaaagcgagccgggccacaacactgccttcatcatcaccttcccgccgaatcccgcctgacggatggcatggtttcgaatgccggccggatgcagcctagcgccgctcagcctcgtccgattggccgccatcggcgcgcagcggcctcacctcttgcaacaactgataatcgacatggtcgttttcttcttcgtcggtatagatcaggtcggcgaaaacatgattccagcggatatccagatgcgagaaggtatgacgcgccaccatgggctggatggtggtttcgtctatgccgctgatggacaggatcaactgcgccttcaccgccgccagcgactcggcatcgcgccgatacagcgggctgcgctcatccagcttgtgcaccagcgtccagcccagcacgaacatcgggtgctcgtcgcgcaccagttccaggtcgtagagcttgcgaaacgccgtcccttccgccgtaacttcatgttgcaacaaacgcagacgggcgctggcatcgatgatcacattgtttctggcattggccgcgcgcagcatcagcgccggctcgccgttcaacggcctcaccaccgctaggctggtgaaaacgatgcgcgccctaggccgcgaaaagcgagcaaaggtgacgccggtgatcaaggctatgctcatcatgccgataaagatttccagcatggaaatccagtgggtatacagggtttgcggatgcatgtcgccatagccgacggtggccagcgtctcgacgctgaagaagaatgctccgagaaaaccttgtggaaactggttggcgataccgcctggctgcaactggtaaaagccggcgaacaacaggttcaaggccaggaaagccgccgcgatgaacaggtaaaaacgcggccagctgatggtcatgcagtaatggtataggtcatgcagcgaatgccgcggcatgctgtggatgaacaggctgcgatcgcccgccagaattcgccggacgggcttgctgctgcgagaaaccatcggctgccaccttccagtcggtaaagggctgattttgtgcgggatgcgcgcagtggtcaatggcaagccgcgggggaacggggaggggacggcaaggccgaaacggcgccgccccacgggcggcggccgaaacgcagaaaccccagctcatcgagctggggttctgtatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtatttgantgacctcctcccgcaaaaacgtagcggcgaaaagtagagatttctggcaaatttaagcccatccgggcaggagatttgtcatgaaaaaatcgaagttcaccgaagaacagattgccttcgccttgcgccaggcggagtccggcaccaccatcgccgaggtctgccgcaagatgggcgtctccgaagccaccttctacaactggaagaagaaatacggcggcctgggcgtcagcgagctgcgccgcctgaagcaactggaagaagagaacgcccgtctcaagcgcatggtcgctgacctgagcctggacaagcagatgctgcaggaagtcatccaaaaaaagctgtgaagccggctcgcaaacgcgagctggccaacttcctgatcgacgcgtaccgcgtcagcattaggcgtgcgacggccgttattcagctgcggcaagctacctatttttatcgccctcaccctcgagacgatcgtgcggagcggcagcgaatcctcgagatcgccgccactcgcattcgttatggcgcgcgccgcatctacgtcctactgcggcgcgaaggctggcggatccatcacaagaagacctaccggatctattgcgaggaaggcttgaatctgcggcgcaagcggcccaaacggcgagtggcagcggcgcatcgccacgctcggccggccgtctccaatttgaacgcgtgctggagcatggatttcgtcgccgatcagctgttcaacggccagaaaatccgggccttaactgtggtggataattttagccgggagagcttggcgatcacggtggatttcgcactgaaagccgcggacgtggtggctacgatgcagcatgtgcaagccttgcgcgggacgccgcaacggattcaggtcgacaacggcagcgagtttatttcgttggcgctggaccagtgggcctatgagcaaggcgtcacgctggacttctcacgaccaggaaaacccacggataatgcctttatcgagtcatttaacggcagtctgcgcgatgagtgcctgaatgtgcattggtttctatcgctggacgacgcacgtgaaaagatcgagcgttggcggcaggattacaacgaattcaggccgcacagttcgctgggcgaccagaccccgagcgagttcagacttgctcaccttgaagccggaaatctctagactagaccgctcggttagtcgggtggaggtcaacctagtatccattcaaaataaaaagagaggcttagcctctctttttccactcctttttatcctgtaaaaaaaatatcgttatagcttgatcaaagtactcttcagctctgtgtatttttcaagcgcgtgtaatgacttgtcgcgaccattgccagactgtttatagccgccaaacggcaagttcatatccccaccctcctcatagcagttgacccaaaccgtacccgcacgaagctgacgcgccactttatgcgctgtcgagacatcctgagtccacactgccgccccaagtccatattggctatcgttggcaatctgcacggcctcatccacatcatcaaaggtaatcactgataaaacggggccaaatatttcttcacggcaaatcgtcaagtttggctgcgggcaatcaaaaatagcaggctcaataaacaaaccatctgggtggatagcttggacagcagcaccaccttgtagcagcgtagcgccttctttttgtccttgcgctatatatgacaggactttatcaaactgccgttgatcgacaactgcacccaagttcgtttcaggtgacaatggatctccaggacgataatcagccatcgccactttcagttcagacaagaaggcttcgcgtatttctctagccaccaagacacgagaccctgccgtacacatttgaccagcgttataacaaatagcaccagctgccgctctcgcagctgccttaagatccttgcagtctgccaagataatattcgggcttttcccgcccaactccaaccacacgcgcttgagattgctttgtgccgcatagttggcgatctgcttgccaaccgccgtcgatccggtaaaggcgacgcaatccacatccagatgtgatgccaaggcctggccaacgttccccgcccccggcaagacctgaaaaataccaggcggaatgcccgctgcttcagcgagagcggcaatacggattgcggtaaggggcgacttctcagagggcttcagaatgaccgcattgcctgcggctaacgccggagcaaacttccagcttgccatcagcaaagggaagttccacggcacaatagctgccaccacgccgacaggctcgcgcgtcaccatgccaagcaacgccggatcgacaggcacaacctcacccggaaccttgtcaatcagctcggcaaaccaactgatgcagtaagccgtattggaaatatcaacgcttagagcgttggcgatgggtttgccaacatccaatgattccaagagcgctaattcttcaatattgtcctggatgagcgaagcaaatcgtttcagtatttccatcttggaacgcggcgccagctcggaccatgcgccaccatcgaatgcccgcctcgctgcacgcaccgctagctccacatcctcttcaccgcaccactcaatagatgccaacaccttgccggttgcgggattgatcgttgtgaactctttgccgctcagcgctttccggtaagcgccatcgatgtaagcgcggccttcgaaatgcaattgctctgcttttttctgccaattgatcgtaccggtagacatatatgctttcctttttttgtactatctctggtttacgtgcaaaaaatcacaaatctagatggtgtgctttctagttcgtcggctttacagcaatcaccccaacactatcccgaccatcatcagacaagcactcagcggggaaaacaccttgtcgattgatgtatgcggcttgctcaaccataaagccatggtcagtgaatagttttttaaaactatcaagatcaaacagatgcaaaacatcaggaatttgattcgaaaacgctatgctatcgtgcatgcgatgattttcgatcaagccaggataaggatggccggcggcaagccttgcttcatattccggcctgaaagacttccaattaccgatgaacggcgtctcgacagttgcataaattcgcccaccgggaattaacaatctagacatggcattcagcattttatcaatgctttgaccattgaagaagtgcaaaacccggcaacacagaatggatgcaatggagttttctgtcagatcaatttcatcaggaaagctaccatctagaaatgtaatccgttgcaacatttcagcaggcacgttcctgctagcaatctctaaatgctctttgcttaagtcattgcatatgactgcatgtccattttttaaagctgaaatggaattcgaaccaaatcccgcaccgatctcaagtagaggaaaggcagataccgactgattgcaaaaagcagtagaaacaaaatccttactgtcggtgatgacgcccgtgttgttgagggtcatcgcacagccagcagcttcaaacagggcatgactatcagatatcatcatggcaacctcattatgtccatgtaaactacaccaaagttatccgaggcacgactatgcagaaatggctgcatattgttggcattcattgttctgataatatcgaagttattgctaatattgagcgaagactttattcttgctagcgctttggaaatagtggaaactgaagtattggtagcaaaagcaatttcctttggttgttttcctgcgcaaaaaagctctagaatcttgaattctttgtcggttagattagataggtacttcagtatcttttcgcgactactctcgctgccctgcttgccttcatcaacttgacttgatgtatctaccttcaaatagttcaacgtcctaaaataaacccactccaatttatttgaagaggaatataatggctctttgatataggtaatttcattgtataccgatccattccggaagcagtgcaaggaaataacgggccgctcctctctcagcacaatcccatcttcagcatcataatcgtgcccttccgaaacagagttgataggcaggtcatacgtgtgcctgcctaaaatctcctctagacatgaagctcccacaacagaaaggtattggctatgcgcataaagaaactggtgcgttttattcttgacaccacagctatgccttgaggagtctatttgtgtttttatgagatctggcaaatctgacattgtaatgaatctccattgatatcattaatatcagaaagctgcggcacgcttgttttctgtaaaagcaatgtgaatcacaaaaagcaaaatcacagccaaccccataaagctggacatgattacgatgccaagctgcggactccccgttgccttgatgacgtatcccatcatgatgggcgacacaaacccagccaagctgccaatggaattgatcacagcaaaaataactgccgcagccttgcctttaaggaaattgactagcgaccaaaatactggataggtcagcataatcgcagtagtcgcaatcgaaattaagccaagctttgttgtcacgcttatgccattaatcaagatggccgaaaatgataagcacccaaccccgtacaacagggacaagacaaaaactggccgttttatggttccgatcatcaaaaatgacgtcgctagcgcgatcagtgccaagccccatgggatggcattgatcaagccgatatgcaatatatcggcaacatcaaaggatttgatgatctgcgggagccagaatgaaatgcaatacatggaaaaggctgaggcagaagtcacgattgcatatatccaaacttttaagtccaacagcgctttcagcggcgacccaatcacagctttggtttcttcctgtgcttgtatgtgggcgcttaactgcaatttttcagcatcagttaaatactttacagacttgatgctctccggcagcacatagagcagtgcaataccaataaaaatggtcataagaccttctgtccagaacaaccactgccatgcagccaagcctaagtagtgcgatttagagatcgtttccaacaaccagcccgaaaatatactgccaatcactgcagatagtgggatggcggagatgaaaaggaaattggtttttgcacgattctctattggaatgaagcgtgtcaaataaaacagcactccgggataaaaccctgcctcacacactccaagcagaaatctgacaatatacagctgagtatctgtgtggacgtagtaagttgacatcgtgaccacgccccagctgatcataattcttgccaaccacctccgtgcgccgaatcttagcaacaataaattactgggaatttctgcggcaatatatccggcaaaaaatacccctgcggccgtcccaaaaaccaatggatcaataccgaatgattttgctaaagagaactgtgcaaaagccaggttggttctgtcgatgtaggccatggttaggcaaatgatcagccagggcacaattctaactgtgatcttctttgctgcaatcgctggtacgctttccattgggagcctctgattgaattaagcaggcgtatcaatattaggattgttctattaaaaaccaatgtgattaatattgatcttcatctcgagtcgaaagtgactcatgaccacaaaacactgtcaaggaaaattattttccttgaggcaacgcctcatcgtttgcattatgcgcaaaccaatgcaatgtcgtttgaatattactcgacaccttatcagttttcatcacgactgtatattggcttgacaataatatttcgcattaaatcacttaactagactcactgatggctttagcaagcgcagccagcttgattgacggcaaccgtgcagaaaaacggattaaaaactaataaaacgaggtgcggatgatgaacacacaggaactgaatttaacaagcgaactggcacggcttttgtactatacggctcacattgctaccactatccggcagcatagtaagcaagcgactggccgcactcaccgcttacgaaacggtaaagacatttgtcaactcgcggacacgctgcacaactttgacctgctgggccatgccatcctggctaacaatccgaaaaccatgctgagggtttgcgatctactgctaaaggactaccaacgctacattgagcgctatgcagtcgcgcttgccaatgtagaaacttccggaaatataaaagcaggcaactatatggtggatttgcaggaaggcatggaaattattacggaaatacaaaccagggttagaccattcaccaagatggcaagcgcgcactaaggtggtcgatcttaaagtcttacgcttacccatctgaatcacattttgatttctacccttgccccattgctgcacatggggcttttttcctctctgctcatctgctcaaaaagctgctctagcagttcctccacctccgatgaaatagttacgccatcgctacaaaccgaagccaggtactttctcctttccgcccttttcgcttcagcacttttcccttttaaaatccgcgtcactcggctaatggctttttcaaatatgactttcattgtgcgctcctaatcgaatctagattttttcaactacatatcatcgacttgagctgggcttgttttgtcaaaatcgttctgatcctccccttcatccatttgaaatgatgaagcctcccctcatggagttcgatatgtcgcatctagtggaaaccatggcctatgtcggccaaatcccttggcatggcttgggcaactgcctgccggctgggcagcctgtcgaggtctggcagcgcgaggcgggactggattggtcgatccaggaagcggaggtgctgttcaacaacaccgctgccgatgccatccatatccgcgctcacagcgatgccaaggtgctgtatcgtcggatacgctggcgccgctgatcgcgcgctgagcgtggacgagcagtgctatcagcgcctgatcctgccctatctgatcgagcacgatattccattgctattcgtggtgaatcaggtagacaagatcgagccgtgccgggaatgggacttcatccacagcatgcctggtccgcaacagctgacccacatcagccgcaagcagatgcagatcagccagttgttcaacgcgccagtaacccagatcttcatcatttcagccatggaaggctacggcctgcagatcctgatcgagcaaatcatccataggctgcccaaagaaaaaaagtggagcgtcacgcgagagacccgcgccgagtacgtgacgcctgccatgcagcgggaatccataggtgggctgtgggatacgatcaaagaagccgccaagacgatcttgcgcgaaacctggaccacgatctcacatcgcgtggaaagctggttcagcaaacggttcggctggtagtagagaacaacaggtagcttgggaaggggatgcttggcatcgcatcctgcaggcaccgccttctgactgcgttgattcacagcgaccgagacggatcgaatccgcttacacagcggttacacggtctagaaaagcaaaaaggccaacttctagaaagaagttggcctaatgcttatttggttgcgggggcaggattcgaacctacgaccttcgggttatgagcccgacgagctaccagactgctccaccccgcgtctgaattctgttctgcgctgtttcttgcagagaggcgaactatatacccatgacagccttccgtcaagactttgccggaaaccatatcaaaaacagcgaaaatgcctgttcatactctttaacagatgccgactgcaaaaacataagccatcaacaaaagaccgctacattgacagcgtggtcggtaccgaagcggaagcggaggtgtcacgcaaacggaaaccggtctgccaatcggattcaagatgcgaaatcggcctgtgcattttgacgggtgttgccatctgcaagcgactgccagcgctaacagccaaggtaatgcctgttctcctaagtgttcatcacggaacttcgggccgccttgtgcggcccactttttttgtcttgcggcttaggattccccatgatacccgaattcaatatccgaagccaatcccataccactgcctcgcggcactatgccgcggccagctgcatcgcgacggtcaaacgcctgcgcaacagccaagtggcgccgcacagcaagcccatcaccccataactgatccagggcagcaacagcacggagcgttcaaccggccaatgccatgccagccagctgcgcaacagcatctccgataccaggcccaagccccacatcgccgtcatgaaccgcatgccgcgccgaaaggcagcttgcgcccaaagccactcgcaatgctcgcggccatcttgccgctgcctttccagcgcggcccgcgccaggaaaaacaccagcggacggggaaacagcagcgacaagagaaacgccgcgccgaacagccccgacaacaacgattcgcgcagcagcagcatcttctctccaccgcccagcgccatccccagcagagacagcgcgatgcccaacagcaccagcatgctcatcgcgtctacccgccggctgcgccacagctcccagccgctccacatcagcggcggcgctgcagacagcagcaagccgcccatctctccccaatgtggccgcgcccagcggtagcacagccagggcagcagaaaattgaccagcaactccaacaacagcgtcattcttctcgacatggcggcctcccggaatcaaaccgcaaaactgccgcagcatgcgactgtcgtcaagaaaaacaaagccccgcacggcgcggggcttggctgcgagcccggagccgccaaggcccgggcattcggaaaccggtcaggctgccgcctgaatgaaaccattggcaggatacatggcgctggccaaacccaaagccgatttgaaagtcacttcaaacattttgccgacttggcggatgctgaccacttcatagtggaccacgctgccgctgtccttgtgctcaaaaactttgtagcccggcttcaattgcgaaattttcatgattcacgtcctttgttatttttttactaaaaacatatacatatctgatgttagtcgccgcaaccggaaaaaagttccggtaccaaaatatgtcgtccaatcttgcgaaaactgtagcagatgcggatgacagaacagtgacgagtgaccgaaaggccagtatcgtccgccatccgaaagcaaaaccccagctaccactatggtcgccggggtcttgttatccaagtctcatcaagttacttggtgatactacttattcgccatgacaaaaatcaagcatggcagatcaaagcatcagccgatgcgcatgcccggcttgacgcctgcgtccacatccagcaggtacaggccttcgctatcgtcggtgcccgacgcgcagacgatcatgccctgcgacacgccgaagcgcatcttgcgttcggccaggttggcaaccacgatcacatggcggccgaccagtttttccggctcctgataagccttgcggatgccggagaaaatgttgcgggtttcaaagcccagatccaccttgaactgcagcagcttgtccgaaccttcgacgaagccgcattccagcaccttgccgacgcgcaggtcgaccttggcgaagtcgtcgatcttgatggtttcggccaaaggctcgtgcgcggcggcggccggcgtgtcttgagtcgcttgcatgttttccttgttcgcctctatcagtttgtcgatcagcgccgggtcgatgcgctgcatcagatgctggtaggcgttgattttcttgcccaacagcagggtttgcgcatcgctccaggcgagcggcgccacctccaggaaggcttccaccccttcggccagcttcggcagcaccggcttcagatagatggtgagcaggcggaaagcgttgatcagcaccgtgcagacttcctgcagacgcgcgtcctgcccctcttgcttggccagttcccacggtttgttggcgtcgacatagacgttgaccatgtccgccagcgccatcacgtcgcgcaaggccttcgcgtattcgcgcgcttcgaaggcggcggccagatcctcggcggccgcctgcaacttggccaggatgtccagatccgacacgctggccgccagctggccgtcgaagcgcttggcgatgaagcccgcggagcggctggcgatgttgacgaacttgccgaccaagtcggagtttaccctggcgacgaagtcattcaggttaaggtcgatgtcctcgatgcggccgttcagcttggcggcgatgtagtaacgcatccactccgggttcaggccgcagtccaggtagctcttggcctggatgaaggtaccgcgcgatttggacatcttctggccatccactgtgaggaagccgtgggcgaacacgccggtcggcgcgcgcaggccggaataattcagcatcgccggccagaacagcgcgtggaaatacaggatgtccttgccgatgaagtggtacatctctgcctggctgtccttggcgaaccattcgtcgaacttcaggccggagcggtcgcacaggttcttgaagctggccatgtagccgataggcgcgtccagccacacgtagaagtatttgcccggcgcgtcgggaatctcgaagccgaagtaaggcgcgtcgcggctgatgtcccagtcctgcaggccgccgtcgatccactcgttcatcttgttcagcgattcctgctgcaggtgcggctgctcgacgccgtcggcgcgacggctggcgccgctggtccactgcttcaggaaatcggcgcattcgcccaggcggaagaagtagtgctcggaggttttcaacaccggcttggcgccggacaccgccgaatacgggttcttcagttcggtcggattgtaggtggcgccgcagacttcgcagttgtcgccgtactggtccttggccgaacacttcgggcattcgcccttgacgaagcggtcgggcaggaacatctgcttttccgggtcgtacagctgctcgatggtgcgcaccgcgatcttgtcgtcggcccgcagcgccttgtacacctgctccgccagctccttgttttccgggctgttggtgctgtagtagttgtcatggccgatcaggaagccttgcgaatcggccacatgcagcgcgcggacttcgtccaccagctgctccggggagatgccgcgcttttccgccgccagcatgatcggggcgccgtgggtatcgtcggcgcagacgtagtagcactcatggccgcgcatcttctggaagcgcacccagatatcggtctggatctgctccagcatatggccgaggtggatcgcgccgttggcgtaaggcagcgcgctggtcaccagaatcttgcgtttggtcattcggatcattccctggattggcaatctcaagcgatcgattatagagacagaagaggcgggcggtcatcaggcttgcgcgccaaatattgccccgcacaaaagcacaagcccggaacgcggcgtttccgggcttgtgaagtcagccaggcggctcaggcgccctggctggccagcctgccgtcttcgacagccggcgcggcgcgctcggccatggcgatgcccaccatcttgcggcccagcagcacgtaggccagcgagaagcacagcgccagcaccgcaaaaccagtgaggcctgaggcctggtaaacctggcggaacagctcgatgcccaccgcgtagccggccatcgagatcatgctcatgctggcggaaatggtgccgcggccggccacgtcgcaggacatcagcgcgaagcggtacagcacaccgaaggccagaccctcgccgaaggccatcaggctcatgccagccaccatccagtattggggaagcgacgaaaccagcacgccgccgaccatcaccgccaggccgccgacgatgggccacatgcccaccaacgcggagcggcccagcggccagcggtcggcgatcacggccagcgccaggttgccggcgatcaggccgccgaacaccggaatctgcatcaggccgtacgcgacggcgctcatgtgcaggtcgcgcaccagcagcaccggcgacagcgcgatccagcccatcagcggcagcgccagcagcgggatgcacagcgcggccagcacgaaacggctgtggccgaagactttcaggtagtcgcgccccatgctggacagcggcagcttctcatggctgggcgccacggtttccggcatgcggaaatacaagcccaccagcgcgaggaaagacaggccggcgatgaacaggaagccgctgcgccacggcgccagctccagcaaggccgcgccggccaaggggccgaccagcggcgcgatcagcgccacattggccatcagcgcggtgacgcgcaccgcggcggtctcctcaaacgactcctgcagcgaggcgtagccgacggcgttgatgaagcacaggcccacgccttgcagcaagcgcagcgcgatgaaggcctcgatcgagctgaccagataggtggccaagcaggcgatggtgaagtaagcgacgccgaacagcagcaccgggcggcggccgatgcggtcggacagcgggccggtcagccacggcagcagcgcaccgcccaccaggaaggcggtcatcgacgtcggcgcccaggaggcgtcgaccagaaattcgcgggtgacggaaagcatggccggctggaccatgtcgttgcagatgtagacggcgaattcgaacagcaccagggccagcgggaacagcagattggaccaggtaagtttggcgtgtttggactgcataaagcggggaaaacctttcgtcgacaaagaacagggcccgcggcctgacagggccgagcctttggcgctgcggcagcgccgcaaccgagaaaaaccgacaattgtactcttttcaaggactttcatcaaaagttattgccgcgcggcgcgccgccatctccccttcccctgccctttgccggcgcacaggagtaagatgggcccttggccggcgcgatgcgcgccgcagcgaatccgactaaaatactcggaaatcatcacccggaacgccgcatgttctccaaactcacccgcctgttcggcggtcaagccgaccaggccacgcaaaacgaaaccatggcacagctcgaatcccagatcctcgataccctcaaaccgctgatcgacgccaataccggcaaagggtatgtggcggccaagaacgtcaagaacctgcagatcgacgacaaggccatccgcctggacgtgacgttggcctacccggccaagagccagttcgacgcggtgcgccaacagtttgaaaccgcgctggcgccgctggccgaagggcgcgccgtggaagtgcgggtcgacagccagatcgtcagccactccgcccagcgcggcgtgccgctgctgccgggcgtgaagaacatcatcgccgtcgcctccggcaagggcggcgtcggcaaatccaccaccgccgccaacctggcgctggcattgtcggccgaaggcgcgcgcgtcggcctcttggacgcagacatctacggcccgtcccagccgctgatgatgggcctgcagggccagcggcccgaatcggccgacggcaagctgcggccgctgatcggccacggcatccagaccatgtccatcggctacctggtagacgccgaccaggcgatggtgtggcgcggcccgatggtcagccaggcgctgcagcaactgctgaacgacacccgctgggacgatctggattatctagtcatcgacatgccgccgggcacaggcgacatccagctgacgctgtcgcagaaagtgccggtcaccggcgcgctgatcgtcaccaccccgcaggacatcgcgctgctggacgcgcgcaagggcgtcaccatgttccagaaggtgaacgtgcccattctggggctggtggaaaacatggccatccacatttgctccaactgcggccacgccgagcacatcttcggcgagggcggcgcggcgcgcatggccgccgatttcggcgtggagctgctgggctcgctgccgctggagctggccatccgcctggccgttgacgccggcaaacccagcgtggccgccgacccggccggcacgccggccgagctctaccgcgccatcgcccgccgcgtggcggtgaaagtgggcgaaaaagcgcaggacttctccggcaaattccccaagatcgtcatccagaacaactgagcggcaccatgattgcgatgtacgattccggcctgggcggactgtcggtgtggcgcgcggtgcgcgccgcgctgcccgcctggccgatcacctacctggcggaccaggcctattgcccgtatggccagcgcagccggcgggaaatcattgaacgcagcctgaaagtcggccattacctggtcagccagggcgccaccatcctggtggtggcctgcaacaccgccaccaccgcggcggtgtccagcatgcgcgaacagctgcccatccccatcgtcggcatcgaaccggcgatcaagccggcggcggcgatgagccgcaccggccgcatcgcggtgctggccaccgagtacacgctggccagcgaccgggtgaaagccttgctcgacgcccacgccggcgatgtggaagtgctgcgccgccccggccacggctgggtggagcaagtggaggccggcgagctggacagcgaacgcacccgccagctggtgcgccaggtggtggctccgctgctgggccagggcatcgaccatatcgcgctgggctgcacccactatcccttcctggccccgctgatccgcgagctcaccggcgacggcatccagctgtacgaccccgccgaggccatcgcccgccgcgtctgcgacctgctgcgccaacacggctgcgacagccagggcgacggctattgccgcttcatcagcaccgccgacggcaacgacatggccctgcgcctgccgcagctgataggccgcagcgacccggtggagtcggtgccgctggactgaaacgccgccttgcgccgcggcgcgccgcggttacaatgcgcgatccaaacctttgcccgggacattcctcatgaaacgcccgctgtccttgctcgccgcgctgctcgcggccatcagcctgaacgcgcatgccgcgcccggctgcttcaatgtcgccggcgacatcgcgcgccagaccggcaaccgcctggatcgccaggaactgacggaagtgctgcagtcgctatcccgcagcggccagctgccgcctaaattcgtcaacaagaagcaggcgcgcgcagccggctggcaacccggccgcagcctgtggagcgtgccggcgctgcagggaaaatcgatgggcggcgaccgtttcggcaactacgaaaagcggctgccggctggccagtggcaggaggcggatctgggctataaaggcggcaagcgcggcgcctaccggctggtgttcagccaccaggggcagcgctacgtcagcgtagatcactacaaccgcttcatcgaggtgccgccatgccagtgaaagtgtgcgaactgcgccacatcgtcagccaggagcaattattcgacgaactcagccgccagctgcggctgccgccccacttcggccgcaatctggacgcgctgtacgactgcctggccaacgacgcgtccgggccgttcgagctggtctggcgcgacaccgccgaatcgaaacaggcgctgggcgccgacctttacgccaccgtgctggagattctggagaccgtcgccgaagcgcgcggcgacgtcaccctggacatccaccactagccgcgcgttgtcgcgccgctacgccagcagccatccggctgctttttttcatccttgcggcatggaaataaaatgccaaaagcaaaattattggcaatttaaatccaaaaatcatcacaatccaacaagcacattcgaatatgaatggcaattctcgaaatcctgccaagacaaccacccgctaactcactataattctgcgcttcggcctgccgcacctgtccgacagaaacaggaaaaaagcctgaaatcaaggctaaaaacaattaagtagccaggccgctacatggcgaagcatgccggacacacggcgccacgcatgatcacaaaaaaacacaatgtcatgcaatcgaaaatgcgccgctcgttttgaatcgtctcaaactcaggcaggaacaactcaatgaagtcgaaaaaactcacggccttgattctggtcggcatgctgctgggcattctggtcggctacctattccgtcagcacgccggcaatgacgccgccgcgatcaagtccttcgtcgatggcatgtccatcctcaccgatatcttcctgcgcctgatcaagatgatcatcgccccgctggtgatctccacgctggtggtcggcatcgccaagatgggcgacgcgaaatcggtgggccgcatcggcggcaagaccatgggctggttcgtcagcgcctcgctggtatcgctgaccctgggcctgatcatggtcaacatcctgaagccgggcgtggcgctgaacctgccgctgcccgacctgcacgccgactccggcatcaaggccagcgccatttcgctgaaggacttcgtcacccacgccatccccaagagcgtgttcgaggcgatggctaacaatgaaatcctgcagatcgtgatcttctcggtgttcttcggcagcgcgatggccgcgctgggcgagcgctccaaggcgctgatcgacgtgatcgacgtcgtcgcccacgtgatgctgaaagtcaccagctatgtgatgaacttcgctccgctggccgtgttcggcgccatcgccgccaccgtcgccaaggaaggcctgtccatcctcggcacttacggcaagttcatggcgcagttctacctgtccatcggcatcctgtgggtgctgctgatcgccgtcggcgtgctgatcgtcggcccgcgcctgttgcacctgatgggcatgatcaaagaaccgctgctgctgtcgttcaccaccgccagctccgaagccgcctatccgaaaaccctggaacagctggaacgcttcggcgtgtccaacaagatcgccagcttcgtgctgccgatgggctactcgttcaacctggacggctcgatgatgtactgcaccttcgcggtgatcttcatcgcccaggcctacggcatagatctgacgctggcgcaggaaatctccatgctgctgatcctgatgctgacctccaagggcatggccggcgtgccgcgcgcgtcgctggtggtgatcgccgccacgctgtcgcagttcaacatcccggaagccggcctgctgctgctgctcggcatcgaccacttcctggacatgggccgctccgccaccaacgtggtgggcaactccatcgccaccgccgtggtggccaaatgggaaggcgagctgaagccgggcaagcacgcctgaggccgcagccgccccgctaccgcgccaccttcgggtggcgtttttcatgcacggaattctgcaacttggtattgacaagccaacccgtcccatctagaatgcgtttcttgtctggcgccggagaggtggcagagtggtcgaatgtacctgactcgaaatcaggcgtacgtgcgagcgtaccgagggttcgaatccctccctctccgccagtcaacccaatagaatcaaggctctgcaatgcgcagggccttttttcttttccgcttcacctctccagtcagcgacacctgtgacagatttgtaccgctgtctaagatgacgtctatcgccgtcacatgcccccgcagatgctccggcgcgaggtgcgcataccgctgcaccatctcaaagctgtgccagccgcccaactcttggatgatgtgcagaggcaccccttcttgaaccagccagctcgcccacgtgtgccgcaggtcgtggaaccggaaattctcgatccccgcccgcttcagcgcacttttccagccggtggccgccttttgcctgagcttatcgccccgataggtgaacacccatctcggatgcttcccgacctgagcaatcagcacctcggttgcggtatcgttcagtggaacaccgatggctttcccagcttttgcatcctccgggttcacccacgctaggcgcttcactagattgacctgcgaccattccaagtcgatgatgttcgagtggcgaagtccagtggcaagcgcaaattgcacaatggaccgtagatgaggggccagttcggcaagtagccggctggcctcttcttttttcagccatcgaatgcgacgggacggctctttccgttttcggaatacaggcgccttttcgatccactcccactcatcggcagccaagttgaacagcgtggacgcaaacgccagatacctgttccgcgtggcatcgctgaccgcgcgcccggtttccctggcgtggcctgtcgaaactccccgcacatgaaccagcttcgaaactgcatccatcacttcgtcacgcttgatactccgcaagatgcggcccctgaaaaatccggtgaaaaatcgaatcttcgtgacgtcatcggcaaagcttttcttgtttgccttctcccttgcgtaccgcaagcacgcttcgtcccaggtgtactctggcttttcgcccaactggtcaacccgccagcgttcggccatcagcttgtcgtagaattcctgggcctgcgtcctgtcacgcgttccaagagactgtctaactcttttaccgcttggcgttgcgaaatcacaccaccaagtctttcctcgttgatagatcggcataccgcttcctctcccttctcgctgccgacctgcacctcttgccggctattattttggtcgccgcggatgtgcgccacaagatccgatttcaagaaaacccagccgcgcccgaccttccgacctggcagcttcttcttcctggccagttggtagaccgtgtcctcgcagcagtggaggaacaccgccgcctggccaatgtccattgtggattcgtccatgtgagttccccataaggaagggccgccctctggcagccctcaaaacacaatctcaggatcggcccactggccgccccactccatgcccggcaccgccacccactccatccgggtgcagctggtgccgggctcgggcgtcggcggctccgggccaacgtagatgacggcgccgtcgcggcgctgggtgtagcggtagaccggcggggccggtaccgcggcggtcacgactgatcctgctgcgccatggtggcgtcaatagcagcttcaggggtttcgtaggtcagcgcgccgggcacatgctccccgatatgccactcgcggggtccgcgcgtggggtgaatctgccggaagctgcgcgggaacccattctcagcggcgtagcgccagcgtgccgcgtcgcgcggccgcggcgtggcggcgagttgcttcagcgcgtgcgctaccgcacgaatcccctctgcatggcagttcatccctcgggcatcgatggaatcggccgctgcgtctaaggcatcgaaattgccgaatagcacgtcacgccacccctccggcacagccggcgcgggctgcgggcaggtgtagagcgcaaccggcgtattcccctcggcctcctccagcaaatcagccagtgccatcagcagcgcatgctgatcttcgtcggcgaatatgccgacgctttcgtcgcgctccagcatgctgcttgccatgtcgcgcaggttgccgattgccgctgcgtggctgtctctgcgcaccttcggcagttcacccatgcggtcagcctcgccgctctgctcggtggcggcctgcgccggctgcattgcggctaaatacgactcgatggccgccctggcgatttcagcaacgagatcaccatcgtcagcgatgggcacgaaatcgtccggccccatggtgccgacgccccaggcagaccagacgcggacgcagtcgtatgcgtctttgccgatggcctctgcggtggcctcgatcacgctgtccggcagatcgccgacagcgattgcggcgcgtgcggcgtccgccagttgggtcaggggttgcatgctgcctccgtgtcatttggggtcagcctgacgcgcaggccatcgatgacaaattcctgtgcaccgcgtacatgacgcttcacttcatgttcagtgccgcgcggtgaccgccgcagatgttgcgccacccaatgcaggatggccttacgacgactgcctgccatcggcccatctcggaggaaaaacacatcttgataggcattcagcgggatcggaaatttgatctcggtggcatccttgaccgtggccagcatgctgccacttcggtgcgcatcctcgacgagggaggcgactataatggcaaactccccttcgacacttggcgtgcagatggcgtggccttggatttttgctggcaacgggcggccgtttttgtcgagcgctaccactcgtttcatgtagtcgcccattcccgatgacagcaccgtacggccatgcatttcgtaccagtgcgacggcttgccgacataggcaacgccacgcggcgcttgtcttagacgtctaaacccataccatttgagcgcgcctccagacagcatcatcagttcgacctcattgccaatgatgtcggccggatgtgccatcaacagctctggcgtggtagcgtaaatgcgctcgtcatcagtcatgtcgaatgtgtaggctgagttcggcagcatctcatcgaagcgcagcaaagtcccttgatcacgcagctccaggacgtcgccatttccattcctcacagggaactgcttcgtggcggcacttttgtggttcgcatccagcgccaataggatcagggtttcgagctggtcggtaacctccattttttcactcctcgccctggtcgggcattggtgccggctgatcgggcagccagcggtcgtaggggcagctcatgcggcgtcctcctcagaagtcgtgcaggatggtgaatgctgctgcagccactcgcggaacctggccgttcccaagggatttaagtcggtccaccctatgggccaccccattagccactcgacccagtcggggttcagctggccacccacagattggggcaggttctccccttgtttgccgccggttcgatccaggcaggatcgacctggggagcgatagtcccgcctgaccggagttggccagagctgggttgcttggtgcaatgacagccccctcttgcccctggctatgcacccttttcctccggcctgccgcgagtcctgggcggtcggcgtgggccagaccatcacctgggccgacagcttcggctcgccgcggctgttccacttcccggccgagcggttcactgcatcgtccgcaacgggcgtttgccacaagccagatgcggtcccgctgatggggcgctccaaggtcggatgccgcaagacaagcccactgcgcgtcataccccagcgcggcaaggtcaccgatgaccacggcaaggcctcgtcccacaagcagcggtgagttctccacgaggacgtggctgggtcgtacctcgccgatgattcgggccatttcacgccagaggcctgagcgcgcgccgtcgatgcctgcgccggcgccggcggcgctgatgtcctggcacgggaatccgccagaaaccacgttaacaaggccgcgccatggccgtccgtcaaaggtgcgcacgtcatcccagatcgggaaatgcgggagaaggccgtcattctgtcgggctgcaagtacagccgcggcgtagggctcccattcgacggcgcaaacggtgttccatccgaggaggtggccgccaagaattcctccaccagcgcccgcgaaaagtgccaactcattcatgccatcctcaaaaagaaagaggcccgcgcgggcctcgtgtgttggtgctgggcttacagctcgcccccgtcgctctccaccccgtcgtcggggtagcgcggctcatcggcctggccggccgccgccggcagcggctcaggccgcggcgtgacgtggtagtcctcgccgtaggtctggtagatcacgctgcctcccggtgccgcaggatgccgaaatacacctcgcggcagccggccacgtccaccatggcgttgtgcgcgccgagcagatcctggccagtgaagaacttgtaggcctccgccaaattcggcggcttcggcccggtgcgcttggcggccagcatcttctcggtcggcggcaggttgaccagtttggtgctgttcgagcaggtgcagaacgccgcgccggctttccattcgtcggcgcgctcgtcaccatacagccgcatcagctcgattcggatcatgcgagcgtcgaacggctcgttatgcccgatgcgccgctccaccnccgccagccttcgcgccgcagtaggacgtagatgcggcgcgcgccataacgaatgcgagtggcggcgatctcgaggattcgctgccgctccgcacgatcgtctcgagggtgagggcggtaaaaataggtagcttgccgcagctgaatgactgcggtggcgcgacggatgctgacgcggtacgcgtcgatcaggaagttggccaactcgcgtttgcggcccggcctcacagctttttttggatgacttcctgcagcatctgcttgtccaagctcaggtcggcgaccatgcgcttgagacgggcgttctcttcttccagttgtttcaggcggcgcaactcgctgacgcccaggccgccgtatttcttcttccagttgtagaaggtggcttcggagacgcccatcttgcggcagacctcggcgacggtggtgccggactccgcctggcgcaacgcgaaggcaatctgttcttcggtgaacttcgattttttcatgacaaacctcctgcccggatgggcttaaatttgccagaaatctctacttttcgccgctacgtttttgcgggaggaggtcagtcacaaggcctgaatgcgctcctgctcgttgctggggagaagagggctttgcatctagattgactccgtgatgcggtatacaaatatagtatcgattcggatttgccggtttcataatccgggccgccgaattcaggcaaccgccccggcagcttccgccgggtttttttcttggcggctggagaggcgccgggatgtctcgccgtgcggtagtgtcgtcgcagcgctagtggtatggtttgtgttgacgttgtcattttctggcgcgatcgggaggaggcggagtgacgaattcgcgggtgagccgtttctgccatgctctggcgctgtgcgccgcgttggccgggtgcgcgatgtcgccgcgggggggcgagctgtgcagcttctccggcgcggcgcagtcggcaaggccgggggcggtgatcgtcaatctgtacgctttgggagagggcctgccagagctggccgcgcagcaagtgttgccgcagggtggggagtggcggctggcggccgcgccggggcgctatctggcgttggcgttccaggacgaggcgggcgaccagcaatggagcggcggcgagtcttggggcgaggccggcggcggcgagccgctggtctgcgcgggaggcaggccgctgcgcggattggatatcgatctgggatcgcggcagccaggcggcgaggtgcgcaagatgctgcaggagtcacggcctgggccgcttgctctgccgcagggccgcgcgttgagcgtgggggaggtcggcaggatggatgatccgctgtggacgccggagtatgggcagcagggcatctggcatccggacctgtttatgcgccaggcgcatcccggcatttatttcctgcatccgtaccaggagggcaagatcccggtgctgttcattcatggcatgggcgggacgccgcgcaacttcgacacgttggtccagagtttggacgtcagccgttttcagccatggctggcgttttaccccagcgggagcgatttgacggtttcggcgcaaatgctgcacgtggttttgctgcaattgcagcggcgctttcattttccgagtttggtggtggttgcgcacagcatgggcgggctggtggcgcgccagctgttgctggacatggctgtggatcggtcggcggtcacggtgccgctgctgttgacactggcgacgccatgggccggggatggcggcgcaggcgtgggggtgaggcgcacgccggcgccatgggtagtggacagctggcgcaatctggcgccggacagcgtttttttgcggcaattattcgtgcgcgcggacggctcgcccaagacactgccggcggcgacccggcatgtgttgctgttcggctttcagcgcggcagatggatgtcgcgggaaccaggggatggccgggtagcgctgagcagccaactgcgcgacgaggcgcagagccaggcttcccgcatcaagggttaccagcaatctcatgccggcattctgcatgcggatgaagtgtcgcgcgatgtcagcgcggcgctggccagctatgcgctgccggctgctggtcagccggatggcgggcgaaggccgccaatgctgcgccgctgatgcggtaatacaccttgtcctccaccacgccggcgcctattcggtcatagaaggcgagggctgcctggttgccgcgctcggcggtccagtccagccgttggcagccgcgctccagcgccaagctggctaaggctcgcagtagggcctggccggcgccgctgccgcgggcttccttgcgggtgaacagatccttcatgaacagctggccgctgtactccggcgcggggtagagcagggagaatgtcgccaggccgagcgtttggccatcgcgctgggccagcatggtctgcacgccgcagtgcggctggaacagattggcggcgacatagcgtgccgaggcgtccagattggcgcggtcggcgccgaaataatgccggtctatcaggtaaaacagctcggccagcacatcgcaatcggccggtgtggccagtcgggtagtgatcatgtctttatcctgtcgggccgggtgttgccggccatggctcggatggagcggaggttattccagatcgcggcggaacacccaggtcagctcgctggaggctgaggcgtcgaaagcgtagccttcgctgtcgaagtcgcgcaaagcttccggctgcagcacgcgatgctcggcggcccagcgcgccatcaggccgcgcgcgcgcttggcgtagaagctgatgatcttgtactggccattcttgcggtcctggaataccggcgtcacgatggcggcgttcagctgcttcgctttgaccgacttgaaatactcttccgatgccaggttgaccaggacgctttgtcccagctgttccagttgcgcgttcagcgcgtcggtgacgatccgtccccagaactcgtacaggttcttgccgcgcgggttggccagccgggtgcccatttccaggcggtaggcctgcatcaggtccagcggacgcagcacgccgtacaggccggacaggatgcgcaggcgctgctgcaggtagccggtggcgtcgggactcaggctaccggcgtcgaggccttcgtagacatctcccttgaaggcgtacagcgcctgtttggcgttgttcggggcaaatggcggctgccagtcggcgtagcggccgacgttgaggttggccagcgcgtcgctgatgctcatcaactggctgatttccagcgggcttttgcgtcgcagctcgcttatcagttcggcgctgtgctccagcaggctgggctggctgaattgcgcggaggcggggggcgtctggtagtccagcgtcttggccggcgagatgaccatcaacatgcggcaaatccttttgatgaatagccggctattgtagcaagcttgccgccgcgggcggcgcgcggcggcgggattggatagaatgaaccgtgtgtgatgacgaggaggagccggatgcgggtgttggtgcagagagtcagccaggcggaggtgacggttgccggcgaggtaaaggggcgtataggcgaaggcttgctgctgctggtgggcgtggaagaggcggatggcggcgacgatatcggctggctggtgcgcaaaatcagccagctgcgcattttcggcgacgagaacggggtgatgaaccgttcgctgctggagagcggcgggcaggcgctggcggtcagccagttcaccttgcacgccagcgtgaaaaaaggcaatcggccatcgtattcgcgcgcggcgcgcggcgagatttcgcagcccttgttcgaccgcttcgtcgccgaactggcggcggcgctgggcaagccggtgcctaccggggtgttcggcgccgacatgctggtgagcctggtcaatgatggtccggtgaccatctggctggatagccgcaatccggagtgaggcgatgaacaagctgccgtggcgggtgctggtggtgccgtattacctgaaccgctacgcgcgccaggtgcatgtgttgcgggtggcgctggcgtttttgttcggcttgctgctgacgctctggtccggcatgccgcatggcggctggatgctggtgacgattttgatcgtgttgggcggcgcgccgcactggggcggcgttcagcgcaaggccttggagcgtatgggcggttcgctgctgggggcgctggccggcctggccgccatcgtgctgcatggctggtcgccgtatgcctgttatgcatggatggcggcggtggtgggtctgagcacctggcacgcccagggccgcggcggttacctggccttgctgaccggcatcacgctggtgattgtcggcggcctgggcgacgaacccatcgccgaagcgctgtggcgcagctgcaatgtgttgatcggctcgctgatcggcatggcggcggcggccacgctgccgttgcgggcgatagacagctggcgctttctgctggcggacaatctgcgcgaggcggcgctgctgtacaaccgcatcgcgcggcgcctgccggtggagggcgatgccgcgctggcggagttcaacgctcggttgatcctgatgcggggcttgctgccggcggtgacgcaggagtcgtcgctggcgcacggccggctggagcaggtgcagcgttgccagcgcggcatgtggacgctgctggaccggatggcggaagtggcggcggcgacgccggccttggcggaggagcgttcgccgcggcgcgccatcgtgcgcaccttgctgcgcgcggcgcatgcgttgcgtttcaaccagccgcagctgctggagcagcccttgccggcggctgacaatccgtcgcggatgcagtggccgtcgcattgccattggctggtggcggagttgacgctgacggtggaggagttgcggcaaaacctgcgccagacgctgccgcagctgatcgcggtgccgccgccggcgcgcagcctggtgcggcgcatgctgggtttggggcgggggatgaaatagcccaaggacgcgcgccatcggatatgaaaacggcccggaatgttccgcgccgttcatcgttcagctaggtggcggcggcgctcacaggccgacgatcttcaccttttgccccggctgcaggcgactggcctggcggctgccattgaggcgctggatgtcgtcgtgcttgacgccgaagcggcgggcgatgctgaacagggtgtcgccgcgtttcaccgtgtattcggtggagtggcgggccggcgcgggccggctgtcgctgacctggatcagggccgggtcggcgtcgcggtcggacgggccggcgctggccagctgagtctcgccttgttcgacggattgcagctgcagttgctggccgacttgtaccatattgccgtccagcctgttcagcgacttgagttcttccacggccagattgttgcggcgggcgatgctgtacagggtgtcgccgctggcgacggtatagctgccgatatcgcgggtggccagcgacttggcggcgccgtcctgaactccggcgctggcgatcaccacggtttgacgcggggcggcatcctgcgcctggggcgccgcgggggcggcggtagcggtcatgatgacgggggcgggagttgcctgagcaactgcgggcgccggctgcggcgcggcggcggtgtcggccttggccagcagggtggcgccggccggcgcgtcgccgatctgcgcatcggtggactccagcggctggccatcgttcagggttttgttcatcgccaccagaaccggttggccggccttcagcgtcgggctgttcaggcgattggccgcttgcagctggccggcgctcatgccgtggctgctggcgatgctgttggcgctttcatcggttttggggatgtagacttcccaggtcagcagcggctggttccatttgtccagattggcctggaacttgtcggccttggcggcgggcagcagcatctgccggccggccttgtaggcgaacaccggcaggttgaaggccgggttcagctctttgaactccgccaccgatatgccggccagccgggcggcgatgtcgatgttcatgtgcttgctggcggaaaccgcgacgaagtagggcttgttgggaaacttgtccagccgcacgccgaatttttccggattcagcaggatgttgcgcaccgccagcagcttgggcacgtagttgcgggtttcgttgggcaggcggatgctttcgtaggtggccggctggcctgcggcctgcgctttggcaagcgcgcgcgcgacattgccttcgccccagttgtaggcggccagcgccaggttccagtcgccgaactgggcgtacaggttttgcaggtagtccagcgcggcgcgggtcgactccatcacgtcgcggcggccgtcgtaccaccaggtttgctccaggccgtattgacggccggtggccggcatgatctgccacagcccggacgcgccggtgggggagatataagcgggcacgcgcgacagcgcggtgggaacgaaggcgctttccaccatcggcagcagcgcgatttcggtcggcatgccgcggcgctccacctcgttcatgatatggaacaggtatttgcggctgcggtccagcgtgcgcttgaagtattccggccggctggcgtagaaacgctcctgccggcgcacggtgtcggcgttgacctcgtccagccggaaaccttccctggcccgtttccagacgtcgtcgccattgcgcaacaggctggagttctgcagcatcatatccaggccggcggccatcccttcatctacgccgggagcgcgaacgacggggtcggcgccggcgatggccggcgatgcggatagcaatgctagagacacggttagtgccaacggggtgaggcgtttcatgcagacgggcccataattcagattccggctgatcctaaacatgcgcatatggggtgtcaattgaaaaaaccacatattttcatgcgctttcattgttaatagcctatttgccaggcgtgtgaagtcgattggcgtccggcctagggaatttacttatcctgcatggggtttttagcggaaatcgttcttccaggcgcgcaggcgagcgaagctgtcggcctctgcgtcgtcggcgcggccgccttgcgccagcagggatgcgcggatggccggctcctggcagcgcaggaaggggttgctggccagttcgacggcgatggtgctgggcagcgtgggcaagccctgctcgcgcagcgcctggtcgcggctttgccgcatcgccagcactgggttgagggggtcggcggctagggcgaagcgcagattcgacagcgtgtactcgtgggcggggtaaactttggtccggggcggcagttgcgccagttttttcagcgaagcgagcagttgcgcgggcgtgccctcgaaaaccctgccgcagcctgcggcgaacatcgtgtcgccgcaaaacaggtggtcgccgatccggtatgccaggtggtccagcgtgtggccaggcaccgccagcacctcggccggtccgaacgcgagcggcacttcatcgccttccttgaccgccgccgtcacgccggagatgcccggcgggccgtataccggcgcatccggccagtcgcgggagagttcggccaggccgccgcagtggtcggcgtggtggtgggtgatcaggatggcctcgagccgcagcttttcccggcgcaggaacgctagcaacggcgccgcgtcgccggggtcgacggcaacggcgcgatcgtcgagccgcaaaacccagatataattgtctgagaacgccccgaccggggtgacgctgaacttggctggcataaggccttcctcaatgaaaaattcgtttggcggctggctgaccggcaccgaactgggccgttatctgctggcgcgcgagcaagattacttcgaacgggcggtggctgacgtgttcggctaccacgcggtgcaggtgggcgtgccggagatggactgcctgcgcggcaaccgcatcccctggcaatgccgggtggcggaggccggagaggtggatgtccgctgcgatccggccttcctgcctttcgagaaccgcagcctcgatctgctggtgatgccccatgtgctggattttaccactctgccgcaccaggtattgcgtgaagccgaccgggtgctgatgcctgaggggcggttgatcctcacgggcttcaatccgctgtcgctgtggggcgtgcgccgcttgatccaggggcgcgagtcggtgccgtggaacggcagcttcctgacccaactgcgggtgaaggactggctgacgctgctggatctcgagctggaagaggcggccttcatggcctatgcgccgccgttcgcgcgcggcgactggctgtgccgctgcgacttcatggaagacgccggcgagcgctggtggccgctggccgccggggtatacggcatcgaggcggtgaagcgccagcgcggcatgcggctgatcaccccaaactggaagcagaagcaggccaagaacaagggcgcgctgggagtggtggctggcaacgagcgccagcacacccacaagcgccccgacgcaaccgagcgggacggcgcgccgtcctgccattgactagagacagcatgacaacggaagacaaggtcgagatttacaccgacggcgcctgcaagggcaatcccgggcccggcggctggggcgcgctgctgcgctacaaggggcgggagaaggagatattcggcggcgaacccggcaccaccaacaaccggatggagatcatggcggtgatccgcgcgctggcctcgttgaaccggccgtgccaggtggtggtctataccgactcgcagtatgtgcagaagggcatctccgagtggatacacggctggaaggcgcgcggctggaagaccgcggccaaggagccggtgaagaacgccgacctgtggcagcagctggacgccgagcgcaaccgccatctggcggtggagtggcgctgggtgaagggccacgccggccacgaattcaacgaaagagccgaccaactcgccaacaagggcgtggagacggtctgagcaagacaagttgcggccgcccgccatggagcggcccgcgggaagcagcatgagacagattatcctcgataccgaaaccaccggtctcgatcctaaccagggccatcgcatcatcgaattcgccggcctggaaatggtcggccgcaagctgaccggcaagcacctgcatctttacatccatcccgagcgcgacatcgatccggacgcgcagcgggtgcacggcatctcgctggagtttctcgccggcaagccggtataccgccaggtggcgcaggaaatcgcagatttcctgcgcggcgccgaactgatcatccacaacgcgccgttcgatgtgggcttcctcaacgccgaattcgccaagctgggcctggagccgatcgacaagctgtgcgccagcgtgatcgacacgctgcgcgaagcgcgcgacatgttcccgggcaagcgcaacagcctggacgccttgtgcgaccgcttcgagatcgaccgctccaaccgtaccttgcacggcgcgctggtggactgcgagctgctgtccgaggtgtacctgtggatgacgcgcggccaggaaagcctggcgatggacatcgacgtggagctgcccggcgacgccggcggcgccatccagttcgagcgcaaaccgttgacggtgctggccgccagcgaagcggagcaggccgaacaccaggcctacctcgacgcgctggacaaggcggtgaagggacagtgcctgtggcgcagcctggagcagccggcgcaggcggagggctgagcatggccaggtatatcgccctggtgccggcggccggctccggcagccgtttcggcgcggccagtcccaagcaatacttgcagctcaacggcaagccgctgatgtggcacacgctggccacgttggcggcggtgtcggcgatagacgaagtggcggtggtgatttcgccgcaggacgaatggttcgacgacttcgcctgggatctgcccaagctgcgggtttgccgcgtggggggggcttcgcgcgccgaaagcgtgggcaacggcctagcggcgctgggatgcgatgccgacgactgggtgctggtgcacgacgccgcgcgctgctgcctgtcggtggcggcggtggagcgcctgatcgccactctgtccggccaccaggtgggcggcctgctggcgctgccggtgccggacaccgtcaagcgcgcggacagcgaaggccatgtcggcgccacggtgccgcgcaacggcctgtggctggcgcagacgccgcagatgttccgcgccggggtgttggaaaaggccttgcgcgagcagccggccgacgacatcaccgacgaggcgtcggcggtcgagcgcgccggcctgaagccgctgctggtggaaggcgacgcgcagaatttcaaagtgacctacccgcgcgacctggcgctggcgcgcgccatcctggcggcccgcgacggccagtgaactgcaaaatcaaaggaagaagatgttccgtatcggacaaggctacgacgtgcatcaactggtggaaggccggccgctgatcctgggcggagtgcgggttccgcatgagaagggcctgctcggccactccgacgccgacgcgctgctgcatgcgattaccgacgcgctgctgggcgcggccgcgctgggcgacatcggccgccatttcccggataccgccgccgagttcaagggcgcggacagccgcgcgctgctgcgcgaggccgccgcccgggtgcgcgccgccggctggcggccggtcaacgtcgacagcacgctgatcgcgcaaaaaccgaagctcgcgccccacatcgacgcgatgcgcgccaatatcgccgaggatctggggctggagatcggcgcggtcaacgtcaagggcaaaaccaacgagaagctgggctatctggggcgctgcgaggcgatagaggcccaggccatctgcttgctgatgccggcttgagccgcgccgggccggcatgccatggccggcccgttatgggataatcgcctatcattgctcatgcccgccatgagccctcacacttgacaggaggccttaccatgctgacccaggatcaactgaagctcgccgtcgccaagaaggcgctggaattcgtgccggacgacgccataatcggcgtgggcaccggcagcaccgtcaacctgttcatcgaggaactggccggcatcaagggccgcatcaagggcgcggtgtcgagctccgaggcgtccaccgcccgcctgaaagcccatcacattccggtgttcgacctgaacgaagtggaaaagctgacggtgtacatcgacggcgccgacgagatcaaccaccacctgcacatgatcaagggcggcggcgcggcgctgacgcgcgagaagatcgtcgccggcgtcgccgacgaattcatctgcatcgccgacgagaacaagtacgtggccatgctgggcgcctttccgctgcccatcgaggtgattccgatggcgcgcagctatgtcgcgcgcgagctggtgcgactgggcgggcacccggagctgcgccagggcgtgaccaccgacaacggcaacgtgatcatcgacgtgcacggcctgcagatcatgaagccggtggagctggaggaaaccatcaaccacatcgccggcgtcgtcacctgcggcttgttcgcccgccgccgcgccgacgtgctggtgctgggcaagcaaggcggcgtggaagtgctgcgctaagcctgtctccgcggccggctagatgtcatgtcacggcactgtcatctagccggcttactattgctgtttatcccgattactcgcaacactcagaggcgaacatggcagatcacatttccaaacagttcgatctggaactggaaaccatccggacccgcgtattgcaaatgggcgggctggtggagcagcagattctgtccgccatcgaagcgatgatgtccggcgacatcgcccgcctggacaaggtgatggccgaggacgcgctggtcaatgcgatggaagtgggcatagacgacgactgtctgcacatcatcgcgcgccgccagccggcggccagcgacctgcgcatcgtcttcaccgtgatcaagatcatcaccgacctggagcgcatcggcgacgaagcggcgaagatcgcgcgcatgggcaagaccatccatcaggcggaacgctaccagatgccgcgcttccgcgagatcgagaagatggccgccgtggcgctggcgatgctgcgccgcgcgctggacgccttcgcccggctggacaccagcgccgcgttggaattggcggaagaggacgagcggctggacgagaatttcgccgccgagctgcgccagctgatcactttcatgatggaagacccgcgcaccatcagcatgtctatcgacacgctgttcatctccaaggcgatcgagcgcatcggcgaccattcgaagaacatctccgaatacgtggtctacctggtgaagggcaaggacatccgccacaccacgctggaagacaagaagcgcgagacgctgggacgctgatcgagcttcggacatgacgctggatgcaaaatggcggtaacatttcgcggttaccgccattttgcttgccgcgcgcgccggtgcgcgtttgtccccaggctgcccggcaggcgcaaccgaacaagaaaaggggtgtccttgacacacgccacgcccccccacaccgtactggccaccatcgacctgggctccaacagcttccggctgcaggtttcccgcgtggtggacgaccagctgtacacgctggacgtgatgaaagagaccgtgcgcctgggcgccggcctcaccgccgacaaatacctgaacgacgacacccgcgagcgggcgctggcttgcctcgcgcgcttcggcgagcgcctgcgcggcttcgtggccggccaggtgcgggtggtcggcaccaataccctgcgggtggcgaagaacgccgccggcttcatcgccgaagccgaagagcggctgggcttcccgatagaagtgatcgccggccgcgaagaggcccggctgatctatctgggcgccgcccactcgctgccggacaccaaggagcggcgaatggtggtggacatcggcggcggctccaccgagttcatcatcggcagccattacaaggcgctggtcaccgaaagcctgccgctgggctgcgtcagctacacgctgcgcttcttcccggacggcaagctgacgcgcaacaacttccgcgacgcggtgctggcggcgcgcaacgagatccagcgcatccgccacgaataccgtcccagcgagtggcagctcgcggtgggcacttccggcaccgcgcgctcgctgcgcgacgtgctggagatcaacgactggagccgcgccgacatcacgctggccggcatggagcggctgcgggcggttctgatcgagcagggcagcatggacgcgataaaggtcaacggcctgaaggccgaccgcgcgccggtgctggccggcggcctagccatcatgatcgcggtgttcgaggagctgcaggtcgagaagatgatcgtcaccgaaggcgcgctgcgcgacggcgtgctgtacgacctgctgggccgccagcgcgagaaggacatgcgcgacagcacggtggcgctgttcaagcgccgctaccacgccgacacccagcaggccgagcgcgtcaacctgctgtcggaacggctttaccggatggtggccggagaggatgtcgaccaggacatgctcaagcgcctctcttgggcggccaagttgcacgagatcggcctgaccatcgcccacaccgcctatcacaagcattccgcctacatcctgcagaacgccgacatgccgggcttttccaagcgcgagcaggcgacgctggcgaccatcgtgctgggccaccgcggcgacatgggcaagatggcgcagtacatcggccagccggcgctgtggcaggcggtggtggcgctgcgcctggcagtgctgttctaccgcagccgcatcaatgtcgagctgccgggcaggctggacctgcgccagcacgcgcgcggcttcacgctgtcgctgagcaagagctggctcagcgacaatccgctgtcggccagcagcttccgccaggaagtggggcagtggaaaaacgtcggcttccagctggacattgtgcaggaataggcggcggatgcggcacccggaattgaaggagcggctgcccacgctgggcgaacaggcggggacgctgctgtcggtgggcgaggccaagcatgccggcaccaaactgtccttgttcgatttttgcgccgatgaggcgatcgagctggccgagctgccgctggccaatctggcgagctaccgccgccgcggcgaggtgctgtggctcaacgtctacggcctcagcgacgccgccgccatccaggcgataggcgagcgcttcggcctgcacccgctggtgcaggaggacatcctcaatgcgcgccagcggcccaagctggaagactacgacgattacctgttcctggcctgccgggtgttcgactaccagcagggcgggcggctgcagtccgaccagatgtacctggtgctgggcgacggtttcgtgctgtcgttccaggaaaagccgaccggggtgttcgagcaggtgcgagagcggctgcgcaagggccgcggcgcgctgcggcggcgcggcgccgactacctggcttattcattgctggacgccatcattgacgactacttcggcgtgctcggccagttcaacgacaaggtggagcgcaccgacggccagctgctggccggccgcgacaacggcgtgctgcgccagatccagcggctgaagcgcgattgcctgaagctgaggcgcgcgctgctgccgctgcgcgaggtgctgctgtcgctgaaccgcggcgacgaggagcgcttcggcgaggatacccgcgtctacctgcgcgacgcctacgaccacgtggtccatgtgctggaatcgctggagatgaaccgcgaaatggtcggcgacatgatggacctctatctgtccacccagtcgcaccggctcaatctgcagatgcgggtgctgacggtgatcacgatgatcttcatgccgctgacgctgatcgccggcatctacggcatgaacttcgagtacatgccggagttgaagtggcactacggctacttcatcgtgctgctggcgatgggcgggatttccgcctgcatgagctggtggttctggaagcggcggtggatttgacgctccatcttcgcggtgccatgatgaagctacgccttggtaggctattgattcaaatgagaatggcaggagagcgacatgaagccgttttcggttcatgcgatctgggatggcgaagccggggtctgggtcgcgagcagtaaggatgtgcgtgggctggttgcagaagcgtcgactcgggaggaattggtcgccatgctcaaggcacgcattccagagctgctggagttgaatgatcaaccattgccagagggagagattcgttttcgtctgaaatcagaacaagtctcgaccgaggtcatttgtgactgactttaccgctgcggtaaagaaaaagctgaaggagtatggctgcagttttgatcgccaagggaaaggtgatcatgaaatctggtacagccctatcactcaaacgaaatttccggtggatggcagcatcagatccaggcataccgccaacgagatcatgaaacaggccggaatcccccaccatttctgagcgagatccatgcacatcagccggcattgtgccggctgatttcattttacacctcgtccgatcgcagccgtttgacgccggcctggcgcatcttcatccaggcgtcggccagcgagccgtctatgtctatcgcgcggcaggcgtcttcgaccacgaaagtctcgaagccggcggcgcgggcgtcgatggcgctccaggccacgcaaaaatcggtggcgaggccggccagccagacctttttcacccccagcgcgtccagatagccggccaggccggtgcgggtggcgcggtcggcctcgacgaaggcggagtagctgtccacctgcgggttgccgcccttgcgcacgatcagccgcgcgtgctgggtttccagttccgggtggaagtcggcgccgacgctgccttgcacgcaatgcgccggccacagcgtctgcgggccgtagggcaggtctatcgtctgaaaaggcttgctgcccgggtggctgccggcgaacgatacgtggccggccgggtgccagtcctgggtcagcaccacgttttcgaacagcagcgccaggtggttgatcaagggcaccacttcgtcgccgccggggacggccagcgcgccgccgggacagaagctgttctgcacatccaccacgatcaatgcgcagtcggcaccataacgtttcaggggcatgaggctaccttgttgttgcaggttcagttgtcttgttaacacgccaacggcgacgggtaaagagcccgaggcgcgtctggcttgcgctttataccccttgggggtatataatcagggcaggaggacacgatgacccagtccctgcttaccctgccggtagccggcatgagttgcgccgcctgcgccgcccgcatcgagaaacagctgaaccgcctggacggcgtgcaggcctcggtcagcttcgccaatgaaagcgcgcagctgcgctacgaccccaatcaaacccagcccggacaactggtggacgccatcgtccgctgcggcttcgaggtgccgcgccagacgctgctgctcggcatcggcggcatgagctgcgcagcctgcgcggcccggctggaaaaggcgctgggccgattgcccggcgtggaggccagcgtcaacttcgccgccgagtcggcgaggatcgattacctgccggggctagccgaccgcgaccgggtgctggacgcggtgcgcaaagccggtttcgagccttctttgcgcgaagacggcggcggcgaagccgaggcgcgctatcgccgcgagctggcgtggttcgccgcgtcggcgctgctgacgctgcctttcatggtggaaatggcggcgatgttcgccggcggccaccacggctggctgcccaggctgtggcagctggcgctggcgacgccggtgcagttcgtcgtcggctggcgcttttaccgcggcgcctggcaggcgctgcgcggcggcgtcgccaatatggacgtgctggtagcgctgggcaccagcatggcctggctgctgtcggccgcggtgaccctgctgggtctggagggcgagcacgtgtatttcgaggccagcgcggcggtgatcacgctggtgttgctgggcaagctgctggaggcgcgggccaagggcaagacctcggcggcgatcgccgcgctggcgaagctggccccccgcaccgcccgcgtcgagcgcgatggcgagctgttcgaggtggcggtggagcaactgcaacgcggcgatgtggtggtggtgcgccacggcgaccgcctgccggtggatggcgaggtggtggagggccaggcctggctggacgagagcctgctgacaggcgagagccggccggtggccaagcaggccggcgacaaggtctacgccgccacccgcaaccaggacggcatgctcaaggtgcgcgccaccggcgtaggcggcgacacccagttggcggagatcgtgcgcatggtggcggcggcccagggcagcaaggcgccgatccagcggctggccgaccgtatttccgccgtcttcgtgccggcggtcaccgcgctggcgctgctgaccttcgccttgagcggctggctgttcggcagctggacgacggcgctgatccacgcggtggcggtgctggtgatcgcctgcccgtgcgcgctgggcctggccacgccgaccgcggtgatggtgggcgtgggcaacggcgcgcgccgcggcatcctgttccgcaacgccgccgcgctggagcaggccggcaaggtggacgtgctgctggtggacaagaccggcacgctgaccgagggccggccgacgctgcgccacgcgttggcgctggacggcgacgagaaccgcttgatccagctggccgccagcgccgaggccggctccgagcatccgctggcccatgccttgctgcagcgggcgaaagagcgggaactgcccttgctggcctgcgagcgctttcgcgccgatgtcggcagcggcgtcgaggccgcgctgccgggcgtgggcacggtcaaggtgggcgtgccgtcctggatcggtctggatctgccggcagaggcggctgactggccgcaggaaggcaataccgtggtggcggtgagcctggacgagcggccgctgggtctgttggccttggccgatccgctgcgcgacagttccaagggcgcggtggaagcgctacggagcttgggcatcaaagtggtgatgctgaccggcgatcatgagagcaccgcgcgcggcatcgccgccgaagccggcattgacgagtggcgcgccggcatgaagccgcaggacaaggccgatgtggtcaaatactggcaacagcaaggccgcaaggtggcgatgctgggcgacggcgtcaacgacgcgccggcgctggccgcggccgacgtcagcctggcgatgggcgccggctccgacgtggccatcgccgccgccgacatcacgctgatgcacggcgacctggcgcacgcggcggacgccatccggctgtcgcgcgccagcctggccaaaatccgccagaatctggccttcgctttcgtttacaacgtgctgggcattccgctagcggcgctgggcatgctcaacccggtgatcgccggggcggcgatggcggccagctcggtgtcggtggtatccaattcgctgttgctgcgccgctggcgctgagcgcggcggggttgacgattttcaaggagagaagcatgactgaactggttttgaacattgacggcatgacctgcggcggctgcgtcaaaagcgtgagcggcatcctgggaaccatggccggcgtcgccgaagtgcaggtcagcctggaagagaagcgggcgacggtggattacgacgcggcggtggtgtcgccgcaggagctggcggcggcggtggccgacgccggtttcgacgtcagcttctgaggcctgggatttaggccagttttcccgcggggcgagacgcgttttgctaagcgtcttgccccgcagtccgtcgcgtcgacggcgccgcggccgcggtttgcgcgggcatgccggggggacggacatgtgcacgcattttctgctgcagtcgcaggacaagcaggtcgtggtggggcgttcgatggatttctcccggccgctgacgccggcattctacgtgcaacgccgcggcgagcgcttttcgcagccggtgtgggccggcgcggagttccgcaagatggccgacgccgaggcctggcgggtccgccatggctatgtcggcgtttgctcttcccacttgccgctgcccggcatttcccagcgcatcgtcaccgacggcctgaacgaggcggggctgagcgtcagcttgctgtggctgccgaatgcccgctaccaggaattttccagcctgggcaccacggtgctggcgcccttgttcgccgactgggtgctggcgcattgcgccagcgtggccgacgtctgggagatgctgcccagccggcagttctggctgccggcctggctggccaagtcgctgccgttgcatgccgccatcgtggacaaggacggccgttccatcgtggtggagttccaggacggccagcagaagatctacagcaatccggcgggcgtctgcgccaatgcgccgtggtttccctggcatctggacaatctgggccattacctcggcctgacgcccgacgatccgccgccgcgggagttcggcaatctgcagctgcaagccagcggcggtggcggcctggccaatctgcccggcggctattcctcgccggcgcgctttgtccgcgccgcctatctcaagcagttcgccgatccggcggcggatctgggcgcagcctatgcgctggccgcccagctgctgggcgcggtggagacgccgcgcggcgccatccgcgacggcgccgcgcgcgagcacacccagtggacggtgctgacggggctggccagcggcgaaatcgcgctgcgcgcctatggcggcatgcgttattgcggcctgaggctggccgatatcgatttcgccgcggtgaaaagcggcgaaatcccgctgccggggctggacgacatcgccttcatgcgcgcttagtccgcgcccagcgtgccgtactccaccggcgttttcacgtagaacactttgacgccttcttcgcgcagccgctccagcaggcgctcggcctcgtgcgcgctcagcgccatcgtcacttcctcgggctggtcggccagctcgaaaaagcgggcggcgtggatgcggcggtcgttgccgaagccctcgctggcggcgaacagggtggcgccgcctatgcccaggcggtgggcttcctgtagtatccattcggccagcggcacgccgtgatgacggtgtccctgctgggtgaaaaacgacagctgataaccttgcatggcgggctccttccggcggatgcggctcacagctcgatcaacgtgccttccttcaacgggcatacgcgcaggcctgccggcgcgccgccctgcatctcctgcagcagcatgtcgcggcagcagggataggcgtgcgatatccacaggtgaacattggcgggcagattggccagcaacggcgccagcgtggcgggcgccatatggctctgctcgtcggcctcgtgctggcggtcgttgctgtaggtgacttcgcagatcacatcggtcagcgacggcacgccgcatacccagtgccagaaggcagggcagggcgcggagtcgccgctgaaggccagcgcccgccacgggccttctatcagccagcccatcgccggcacgtggcgctgggctggcagggcggtggccaggccgtcgacgaggggaacggtgtcgccgacctgcaccggcatcatgcgcagccatgggcattccggcgagggcaggcgggtgtagtccggccagatggcgccgttgaagaggtgctggcgcagaatgttcagcgtttccgccagtccatagacttccaggccgctgccgcggtagccggcgtggacgtcggcgagcagcggcagcagcgcgcagtggtcgatgtggctgttggtgagcagcacgcgccggatggcgagcatctcttcggtatcgaggctgccgcagccggtgccgcagtctatcagcgtgtcctggcccacctgaaagcaggtggtctggccaggatggccgacgcaggcggaggcgcccaggattcggatatgcatgcagtgctcccttggcggtgttgatttcattgtagatcaaggcgttatttgcgggtcgcccgccattttctgtagatgatgtgggcatattgtgggcgagggcggccgggattatcatcgtggcttccgcctgcaaagccggcttggctcgggcggctacaaagagataaggggaacgaacaatgcagaagcaaattctgaccgcgctggcggcgtcgctgttggccggttcggcgctggccgcggatattccgctgcgcgactttttccgcaacgccgagcaaagcggcttcagcctgtcgccggatggccaaagcgtggctttcctgtcgccgtgggagagccgcaagaacatcgtggtgcgccgccagggcaagcccgaccagcgcgtcaccgcgatcaaggaccgcgacctgtccggctatttctggaaaggcaacgaccggctggtgtatgtgaaggacaacgccggcgatgaaaacttccacctgtacagcgtggatctcgccagcggcgagagcaaggacctgacgccgttccccggcgtgcgcgtcgacatcgtggacggcctggtcgaccgcgacgacgaactcctggtgcagatgaacaagcgcaacccggagctgttcgacgtttaccgcgtcaatctgaaaaccggcgagttgaagctggaagcggaaaatccgggcaaggtggccggctggctcactgatcacgacggcaatatccgtttggcgatcgaaagcgacggcgtcaacaacacggtgctgtaccgcgacgagccgggcggccccttccgcaagcttttcaccaccaatttccgcgagaacttcacgccgctgttcttcaccttcgacaatcagcgcttctacgcggccagcagcctgggccgcgacaaggccgccatcgtcgaatacgacccgaaaaccggcaaggaagtgagagaagtctacgcccgccaggatgtcgacgtcgccggcctgggcttctcgcacaagcgcaaggtgatcacctgcgccgactttgaaaccgacaagccgggccgccagtgcttcgacgcgcaaagcgaagccttgctatccggcctggaggccaagctgccgggttaccaagtggacatcacctccagcaaccgcgatgaaacccgcttcatcgtgaccgcctggaacgaccgcacccgcggcaagagctatctgtatgacaagagcagcggcaagctggaactgctggccgagctggcgccgtggctgccggaagacaagatggccgtcatgaagccgatccagtaccagagccgcgatggcctgaccatcaacggctacctgacactgccgcagggcaaggaagacgccaagggcctgccggtgatcatcaatccgcacggcgggccgtggtatcgagacagctggcatttcaacccggaagtgcagtttttcgccagccgcggctgggcggtgctgcagatgaacttccgcggctccaccggctatggccgccagttttgggaggcctcgttcaaggagtggggcggcaagatgcaggatgacgtcagcgacggcgtcgactggctggtcaagcaaggcgtggccgatccgaagaaggtgtgcatctacggcggcagctacggcggctacgccaccttgtccggcatcaccaaaacgccggagctgtaccgttgcgcggtggattacgtcggcgtgtccaacctgttcaccttcatgaagaccattccgccgtactggaagccgttcctggattcgatgtacgagatggtgggcaatccggaaaaggataaggatctgctgcgcgaacgctcgccggtgttccatgtcgaccgcatccagtcgccgctgctggtgctgcagggcgccaaggacccgcgcgtcaacatcaacgagtccaaccagatcgtcgacgcgctgaagaagcgcggcgtggaggtcgagtacatcgtcaaggacaacgagggccacggcttccacaacgaggaaaaccgcttcgccgcctatggcgcgatggagcaattcttcaagaagtacctggactgattccaccagccagacgtttacacagcccgccgcatggcgggctttttcgtttacagcgccagccagccggccgccgcgcacaagcccaccaccagccagggcggcagtttccatgcggccagcgccagcaaggccagcaggacggcggcgaaatcggccggcgcgcgcaccgcgctggtccaggccgggtggtacagcgcggcgagcagcaggccgaccacggcggcattgatgccggccagcgccgattgagcgccgggcgcggcgcgcagccggcgccagaacggcagcgccccggccagcaacaggaagccgggcagaaagatggcgaccagcgccagcgcgccgctttgccagctgccgtcgccggcggcgccgagaaaggccgcgaaggcgaatagcggtccgggcaaggcttgcgccgcgccatagccggccaggaaggcgtccctgggcacccagccgctggcgacggacgcggtttccagcagcggcagcaccacgtggccgccgccgaacaccagcgcgccgctgcggtagaaggcgtcgaacaaggccagccggtagcttgggccggccgcggccagcagcggcaggcctgccagcaatgcgaagaacagcgccagccacagcgcgccgcggcggcggctgggcgcggtggcgtcgtcgagcccaggcgcgctttggggcgggggcgtcagccactggcgaccggccgcgccagccagcgcgatgacggccaaggacagccagggcgcgggcatcaacaaggccaggcaacagcttgcgcccatcagcgtcaaccgcggccggtctgggcacagctggcgcgccatgctccacaccgcctgcgccaccaccgccaccgcggccagcttcagtccatgcaaggcgccgggcggcacggcctgggcgtgatgcgacaagcccagcgccagcgacagcatcagcagcgccgacggcaaggtaaagcccagccaggccgccagcgcgccggcgagtccgccccggcccatgcccagcgccatcccgacctggctgctggcgggaccgggcaaaaattggcatagcgccaccaggtcggcgtagtcgcgttccggcagccagcgccggcgctcgacgaattcggcgcggaaatagccgaggtgggcgaccgggccgccgaaggaggtgaggcccaacttcaggaaaaccagcaggatgcgccagaagccgcggtcgttcgccgcatgggttggatgcatggcatgaaaggggtggggaaacagcgccaccttagcggaaaacccgcccggcttgaagcgctacggctgcgacagcggctgccgccagcgccgcgcgccccaatgccccagcaactgcagcaggccgcacaacagcaggtagccgacggcgatggcgctgaagatctccagcggatacacctgctcgcggttgttgacctgagtcgcgacgaaggtgaactcggcgacgccgacgatataggccagcgagctgtccttcagcagcgacacccattggttgacgaaggagggcagcatgatgcgcagcgcctgcggcaggatcagccagcgcagcgtctgccaacgggtaaagcccagcgccagcccggcgtgccattggccgcggcccaccgccgtcaggccggccagcaccgcctggcccagataggccgagtggatcagcgccagcgccaggatcactgtcgctaggccgggaatgtctatgccgaacagcagcggcagcaggaaatagcaccagaagatcagcatcagcaccgggatggcgcgcagcaccgcggtggcggccatcaggccgcgcctaagccaggaggcgcccagcaattgggcgacgcccagcgccagccccagcaggctggccagcagcgccgcggccaggctcagcagcgcggtcaagagcaggccgcccggctcgccgccggacagattgccccacagcaggtagtcgagattgtcctgtatcaccggcggaatcatcgcaatgtcctccattcaggctccggcctttgggccagcagttgggtgatcagcaccaggatcagatacagcgcggtggcggcggcgaatgactggaaggccagcagcgtttcggtttccacctggcgcgaggcgtaggacagctcggccaggccgatggccatcgtcagcgaagtgtttttgacgatggcggtgtactggccgaccagcggccgcttcaccaactgccaggcctgcggcagcaccaccaggcgcagcgcctgccagccgctcatgcccagcgccttggccgccagccgctgccccttggacaccgcgttcagtccggcctgcagctcgccgctgatgaaggcggcgctgtacagcgtcagcgcggtgaaggcggccaggaattcgaacgacggccacggcaacgccaggccaaggggcagctcaagcgcgcgcggcgtgttcagccagatcttcgcctcgtccggcagcaggccggacacgccgaaataccacagcagcaattgcaccatcagcggcgtattgcggtgcaggccgacgaatagccgcgtcgctagccgcagcggccgcggcgcgccgtccagcagcgcggtgaaggcgacgccgagcaggctggcggcggcgatgaccagcagggacagccagccggtcagcagcgcgcccttgcccagccagatcaggtaatgcggctccagccagttgtggccgagccaggcgggtggggtcatgcggatgtctttctacagcggtgaaacggcaaaaccgccggggacgccggcggttgcgaagcggaacgggctggggtcagaccgcgtcgccgatcttgaagtcgcgcggcagcggggccttggtcttgggaccgaaccagcggtcgtagatcttggcggcgtcgccgctcttttccagctgctgcagcgtgtcgttcactaccttggccaggcgcgcctcgcccttgggcaggccgatggcctggtattcgcgggtcagcgtgaacggcgccagctcgtacttggccttatccggcgcgttggccaacagcgcggccagcttggagccgtcctgggtgatggcctggacgttgccgttgcgcagcgcggtgaaggccagcggggtgtcgtcatacgccaccacggtggtcttcgggtatttttcgcgcaggtacacttcctgggtggtgcccttgtccacgcctacgcgcaggccggccagctgttccggcttttgcagcgtgcccttgcggacgatgaactgctggccggaggcgaagtagggcaggctgaagtccacttgcttcttgcgctcgtcggtgacggtgaagttggcggcgacgatgtcggctttgccggataccaagagcggcacgcggttggccgggttggtggcgaccagttgcagcttcacgcccagcttcttggcgatgtgctgggccacgtcgacatccaggccggaaatctggcgggttttggcatcgaggaagccgaacggcgggttgctgtcgaaggcggcgacgcgcagcacgccggctttcttgatgtcgtccaggcggtcggccagggcggcggtggaggtcagggcgacggcgagtgcgagggcgagtgtctttttcatggcgagccttagtctgatgatttgccgatgtgcagcggatggcagtcatcttacccggctttgttaatgcccataaattataaaaaattagttatatattccattttttagttttcatgaggcgcatccggcctgatggacgtgaaaaaggccgggttgccccggcctgtcggttgcgtcgcgccgctgcggtcaagcggccttgcgcttgccgaagaatacgaacaaggcgacgccgatgatgatcatcggcaggctcagccactggcccatgctgatcacatcggacttgccgaagatgccggcgtctggattgcggaagaattcgctgcagaaacgcgctaagccatagccgatcaggaacagcgccgacaccttgccggtggcgcgcggtttggcgctgtagatccacagcgcggaaaacagcgcgatgccttccagcgcgaattcgtacagctgcgacggatggcgggcgaggccgccgtactgcatcagcatgttcatcaggtcggccgattgctgcgcctcggcgacgtcgtcgagccgcgcctgcggaaacagcatcgcccacggcaggtccgggctggccacccggccccacagctcgccgttgatgaagttgccgacgcggccggccgccaggcccagcggcaccagcggcgcgacgaagtcggttagttgccagaaggagcggttcaccttgcggccgtacagcgccaccgcgaccagcacgccgatgaagccgccgtggaaggacatgccgcccttccacaccatgaagatttccagcggatggctgaagtagaagccgggctggtagaacagcacctcgcccaggcgtccgcccagcaccacgccgacggcgccgtacatcagcatgtcgtccagctgggcgacggtcagcacgtcattgccttttttcaggcggtatttccccatgacgaggaacagggtgaagcccagcaggtacatcaaaccgtaccagtggaccgccagcgggccgagatggacggcgaccgggtcgaactgaggatgaatcagcatttgtcagggatgtgcgtttgcggtaaaagaaatgtgacgagattatacggaaagcgttccccgccgtcgcgccgctcacccgcggcgactcggcttctggtttgggccacccggcacccatgggccaaacgccgccagcttaccctgctggcgtgacggaacgacgaccggctttgaacagataaaggaagcctcatgcctcaataccgctcccgcacctccactgccggccgcaacatggcgggtgcccgcgcgctgtggcgcgccaccgggatgaccgacgccgacttcggcaagcccatcatcgccatcgccaactccttcacccagttcgtgcccggccacgtgcacctgcagaacatgggccagctggtggcgcgcgagatagaaaaagccggcggcgtggccaaggagttcaacaccatcgccatcgacgacggcatcgccatgggccacggcggcatgctgtacagtctgccttcccgcgatctgatcgccgatagcgtggaatacatggtcaacgcccactgcgccgacgcgctggtgtgcatctccaactgcgacaagatcacgcccggcatgctgatggcggcgatgcgactgaacatcccggtggtgttcgtctccggcgggccgatggaggccggcaaggtgcagtggggcaacgaggtgcgcaagctggatttggtggacgcgatggtggaggccgccaacagcgcggtgtccgacgaagacgtcgatcgcgtcgagcgttccgcctgtcccacctgcggctcctgctccggcatgttcaccgccaactcgatgaactgtctgaccgaggcgctgggcttgtcgctgcccggcaacggcagcctggtggccacccacgctgaccgcaaggaactgttcctcaaggctggccgcctgatcgtcgagctggccaagcgccattacgagggcgaggactattccattctgccgcgcggcatcgccaccaaggcggccttcgagaacgcgatgagcctggacgtggcgatgggcggctccaccaataccgtgctgcacctgctggccgccgccagcgaagccggggtcgacttcaagatggccgacatcgaccgcatcagccgcggcgtgccgtgtttgtcgaaggtggcgccggcgacgcagaaatatcatatggaggacgtgcatcgcgctggcggcgtgatcggcatcctggccgagctggaccgcgccggcctgattcaccgcgacgtgcctaccgttcacagcccgacgctgggctcggcgctggagcagtgggatgtgatgcgccatggcgaaggcagcgagccgcaccgtttgttccgcgccgcgcccggcggcgtggccaccaccatcgccttcagccagagcatgcgctacccgacgctggacgacgaccgcgccgacggctgcatccgcgacaaggcgcacgcctattcgcaggatggcggcctggcggtgctgtacggcaatatcgccgagcgcggctgcatcgtgaagacggcgggcgtcgatgattccatcctgaaattcaccgggcgcgcccgcatcttcgaaagccaggacgcggcggtggaaggcatcctcgccgaccagatcgtcgccggcgacatcgtcatcatccgctacgaagggcccaagggcgggccgggcatgcaggagatgctgtacccgacctcctatctgaagtccaagggcctgggcaaggcctgcgccttgctgaccgacggccgcttttccggcggcacctccggcctgtcgatcggccacgcttcgccggaagcggccgagggcggcgccatcggcctggcgcaagagggcgacaccgtggagatcgacatccccaaccgccgcatccatctggcggtgccggacgaagaattggcgcgccgccgcgcggcgatggaggccaaaggccgcgacgcctggaagccggtgggccgaaatcgcgtggtcagcccggccttgcgcgcctacgcggcgatgaccaccagcgccgacaccggcgcggtgcgggatgtgtcccaggtcgagaaatgacctatcgggatggcatgaaaaagcagccgcttgcggctgctttttttattttccttaacatgtattcaacgactgttcatacatccggctatctgtttgattatgatgccatttgattgagagggtgtccgcgcgcaattcgccgcgacgcatgggtcggtataggccggcacggatgtccgttctgcagtccaaaacaggccgcccgcgcgggcggcctgcctggggcagccgggcctgagaatttcaccgtgcggtgaaattttcgggcctggctgttattacacggtggagagcgtcaccaccgcggcggagacgatggcgatgccggcccagcctatcggtttgagtttctgcttgtagagcacgcgcgcgcccagcgcggtgccgagtatgccgatggcgccccacagcgcgtaggctatcgccagatccatgcccttcaccgcctggcccagcaaggcgaaagccagccacaccaaggtgatggcgccgaagccccaggccttgcggcggaagccgtccgatttttccagcatcaggttggcccccacttctatcagcgccgaagccagcacgaacaacagatagatggttttcatgcggcggcctcctcgtcatgggtttcgcccagcgtgacgcaagccagccccagcagcgcgagtcccaggcccagccattcctgcggcaccagcttttcgccgaacagccagacgctgaccgcggtcaaccctgccaggcccaagccttcccacactgcgtaagcgacgccgaccgaaatggcgcgcaaggccagagacagcaggtaataggacagggccagcgcggcggccatccagatgtagcccaggtagctgccgctgcgggcggccatggccatcagcgaagtgccgacgatttcgcagccgatggcggccatcagcagcgcccaggcgatgaataatggggaggatatttttttatacatagcgtccaataaattaaacaagacaagggtcagactcggccccaatcggccgagttcctggccgtctcgataaataaaaccggcatatcggcggaattgggcgcatatgggtgaaaaaggcgtaaaaaaaccgccagaggcggtgttggactttgcggacgattctcactgcagcacggtttcgccatcctgcaaggccagcgcgaactgtttgatcgggcgtcgccgctcgatcagttcggccagttgcggcgaatggctggtcacccagagctggctgtaacggctggcttcggcgattaaccttgccagcgccggcagcagcgccgggtgcaggctgttttccggctcgttcaaggccatgaaggcgggcgggcgcgggctgagcagcgccaccgccaggcagaggaagcgcaaggtgccatcggacaattcggcggcttccagcggacgcagcaagccgtcgcgccgcatcagcagctggaagcgtccgtgctgggcatcggcctggaagcggctgtcggggaaggcttcggacaggatgctgcccagcagctcgccatcgccgatctcgacgatggtctggtaggcggcggccaggttggcgccgtcgtgcgacagcaccggcgagcggatgccgacctggagcgcgcgcagcggcgagcccggccagacggcgaattcgtggtaaaagcgccagttgcgcaaagtctcgcgcacttgcgacagttctgggtagcggtgaggctcggccagttggccgaagatggactcctcggcgcgcagggcggcgggataggcgttgcgctctccctcgatgccggtcaggaaggcggcttggttgcgtctttccagcagcagggtggatgggcggcggccctggccggctagccacaggctttcctccttgaccagcgggtccagcgcgaacaggctgaggctgggttccgggtagcccagctgcagctcgtagtcgaaatcgctcagcttggccgacagcgccatccgcctgggggcgccggcgcggtcgccgcggcgcgggccgccggcccacatcgctttttgcgcgccgccttcttgcgccagcgccggcgacaggcggccttcggcggcgtcgtgcagcagcttgatcgccttgtagagattggatttgccgcagccgttggcgccgaccaccacattgagcgcatccagctccagcgtgagtttgcggatggagcggaagccggacaggctgaggctgtgtatgggcatggcggatcggagagtgggaaggcggaatggtttgagactggcgcgcgcgccggcggttcctggccgcggtgggcggcggagccggtcaattgattaggtcttgatgtttgtcataatcaagtcaggcggcggtgctaacatgatcatcgttcctgtccgacagtcgggaagccgggtgagcggcttcgtttccatgccttgccgcgcgtctctgcgccggtctcctatattcggttcgtttggtgaaaaaccgaatcattccttctgttcaatattcgttttgtttcgcaagtgaaatatttgctaaatgacaatagaattatgaattctatgtaacctcccttttgggatgccgtgcaggcttgcggctgggtgattgcagcggctggcctcggcaggttttggcgtgggaatcgcgtttgtgaagctgagatgaattgtgaagagactgtgtctatcgcaatgattcgtaagatttttgtccgaatgaacatggcgggaaggcaaaaaaaatgcgcggtgcctttcggcccgcgccaagtctacaaaggagaaatagaggagaaactatcaagaagcaattgctgcatctcaacgagaacggattatccggattgcggtagcgagtgtcaacatgtgcgtttccgaaaatgtcgagaaatgtaagtttttgtcgcgcttcgatacataggggcgggaaaaaggctgaaacggcagaccttcagcatgtcgtcatgcccggcgcgccgccgccccataacgtggcagctgtgccacaatacgttttttccgtttgcagcaggatgtcagcacatggacgccgtccgccatattcttcccgatccgcgccagtaccacccgcaggtttccctgaccaaccgcctgatccaccatgcccagtcggcgctggacgccgccgacgccggcgagcgcgacatgtggcgccaggccctggtgggagccatggatgaaatgctgcagcgcggcgagctattgtcgatttcggtggcgctggccatggtgccgacccaggcttgctatcagttggtgtgggacgcgctgcgccaggcggtggaggaaaccggcggcgcgcgcgcgcaggtgttcgcgatgccgctggtgctggtggccggcagccgcaacgaagcgacgctgccgggcgagatcgccgatgtcgcgggcctgaacgcgctgctgcgccagcatggcgttttcgccgccgacggcgatgtcgccatatccggcgcgctgctgcatccagacagcctggtgggcttggacgcgatccggctgcatcaattggcccgccaggatggcgcgtcggcccgcgccggcttgccgagccaggcggcgccgatcacggtgaaggaagaaggcgtgttcctgcgctatctgatgggcgtggcggcgcagcgcgacggcgaggcctcgccgctgcgccagggcggctcggtcggcgcctggggcatgccgctgatgaagttcctgggcgagcagctcaagaccgaaggcgtgacgctgttccccatcgcccggccgccgctgccggcgatgcaggcgctggtggcgggcaacttcgcccgcttcgaggtggcgctgcaggtgttcgccagcagccagatccgccgcctgcgcgaattggacaaggagccggtggcgattgtctccgcccatgaaaacggcgaattgcacttcaccttgtcggccaagggcgacgagcgcaattgggaggctttcgtctggccgctggcgtcgctggacaacgtcaagctgatagaagagaacttccgcgagctgatggccgagtgccacgtgcgcgaggtgcatgtgatggccgaactgcagccggaaagccgcgatggcattccgctgttcttcaccgccgacgatttataagccagcgcgcgttcgccggccagacagccccgccgcgagcggggcttgtttttggtgttcagtcggcggcggctggcgtgcgcgcccagggcgagtctgccaggcggcgggccaggtagtcgatcagcgcctgcacccgcgccgggcggccgcggcccggcggcgtcaggatgtagagcgcgatggggtcgacctgccaatcgggcatcgcggtttccagccggccgtcctgcaaatcccgccagaccaggaattccggctgcagcgccagccctaggcccgagtgcagcgccggcgccagcgcgtcggcgttgttgacgcgcagcggcgcgtgcatttccagcgaaaactctccttcatcggcgtggcggaagcgccagtggcggccgccaggcgcgttgctgtattgcaaggcgcggtgccgggccaattgcgcagggtgctccggtttgccgtggcgcgcgaagtaggacggcgcgcccaccagcaggatgcgcaccgcgcacagccggcgcgccagcaggctggagtcggccggcgaggcgatgcgcagcgccaggtccatccgttccgccaccaggtccgcctgctcgtcgctgaagcgcaggtccagttccacctccggatgccgcgccatgaagtccggcagcagcggcgccagatgcgacaggccgaaggacatcggcgcggccatgcgcactgggccgcgcagcgcgcgggattgctcggcgatgtccgcttccaccgcctcgccctccgccaggatgcgcgcggcgcgctccagcgcggcgtcgccggccgtcgtcagcgacaactggcgcgaggtgcgatgcagcagcacggttttcatccggtcttccagccgcgataccgccttggacaccgtggcctgcgacaagcccagctcttccgcggcgcgggcgaaggcgccgcattcggccaccttggcgaagatggcccaggcttccaggtcgggaagtcgtttcatgatggctccggagaagaggagaaactgccgatactagcattccggctagccggtttggcctggattatctaaaaaatggaaatcatggtattcgatatattccattaacgcgatgctggcggcagcttatagtggcggcatcactatcgacagcagcaggagcgcgccatgatcgaacgccgtccctacgccagcctgggcgcagcccagcacggctggctggatgccaagcaccacttttccttcgccgaataccgcgatgccgagcgcacccgctgggggcggctgcgggtgtggaacgacgacaccattgccgccggcaccggcttcgatccgcatccgcacgccgacatggaaatcatcacctatgtccgcgaaggcgcgatcagtcacgaagacagcctgggcaaccgcggccgcaccgaggccggcgacgtgcaggtgatgagcgccggcagcggcatcacccactccgagtacaaccgggaagccgtcgccacccgcatcttccagatctggatctacccggaccgccacggcggcgagccggcctggggcaacaagccgtttcccaaggccgatcgctccggcgctttcgtcgcgctggccagcggcatggacggcgacgccgacgccttgccgatacgggccgacgcccgggtgctgggtgccaccctgaaggccggcgagagcgcgggctaccgcttcggcgcggcgcggcgcggttacctggtgttgtccagcggcgaggcgcaggtgaacggcgtcgccctgcaggccggcgacggcgcggccatcgccggcgaagcgttgatcgaggtgtcggccagccgcgacgccgaactgatcctggtggacacccgcgagtaagcgttcgccgccgctctggcctgcgccgggcggcgcgccagagttgccttcacgtcaaggttccgccgcaggcatttcgtgtagaatggcctgatcgttaacctattgatggaagagccagacgatgtttgctgccgaccagacgattgccaaattcgaccccgaactcgccgccgcgattgccgccgagtgccagcgccaggaagatcatattgaactgatcgcctcggaaaactacaccagcccggcggtgatggaagcccagggctcccagctgaccaacaagtacgccgaaggctacccgggcaagcgcttctatggcggctgcgagcatgtcgacatcgtcgagcaactggccatcgaccgcgtcaagcaactgttcggcgccgaatacgccaacgtgcagccgcactccggctcgcaggccaaccaggcggtgtacttctccatcctgaagccgggcgacaccgtgatgggcatgaacctgggccacggcggccacctgacccacggctccccggccaacctgtccggcaagatgttcaacatcgtcgcctacggcctgaacgacaaggaagaaatcgactacgacgacatggagcgcgtggcgatggaaaccaagccgaagctgatcatcggcggcgcgtcggcttacgccttgcgcttcgacttcgagcgcatgggccagatcgccaagaaggtcggcgcttacttcatggtggacatggctcactacgcgggcctggtggccgcgggcctgtacccgaacccggtgccgcacgccgatttcgtcacctcgaccacccacaagaccctgcgcggcccgcgcggcggcatcattctggccaaggccgagttcgagaagagcatcaacagcaatgtgttcccgacgctgcaaggcggcccgctggagcatgtgatcgccgccaaggccgtcgccttcaaggaagcgctgcagccggaattcaaggaataccagcagcaggtgctgaagaacgccgccatcatggccaagaccctggccgagcgcggcctgcgcatcgtgtccggccgcaccgagagccacgtgttcctggtcgacctgcgcgccaagggcctgaccggcaagcaagccgacgcgctgctgggccgcgcccacatcaccgtcaacaagaacgccatcccgaacgatccggaaacgccgttcgtcacttccggcatccgcatcggctccccggccatcaccacccgcggcttcaaggaagccgaggccatcgaagtggccaacctggtcgccgacgtgctggacaacccgaacgacgacgcgctgatcgcccgtgtcgccgagaaggccaccgcgctgtgccaccgcttcccggtgtacgccaagtaaaaccggccgcgccgcaaaaaaagccgctccttggagcggctttttctttgtgcggcggcggtgtcagaacgcgtagttaagagtcaggcgggccaccggccagaagttcagcttgttggtgtcgtcgcgcagcttgttctgttcgacgccgacatcgttttgcaattgctggcattgcgccgcgctcagcgcgctggtgcagctggcggtcagggtggtatccggcttgccggtcagcagcacgccgaagtcgccgctcaggctcaggcccttgttcttcacgctgttgccgaagcccaggcccaggtacagcgccggcttgttccatttggcttcgccgtccaggtcgccgacctggttggaatagtaggtgttgccgttgaggcggtaggtggtgctgctgccggcgctggcttgcaggcccagcttggtctggttcagcgccaggccgccgctcatgcggaagctgttgccgaacgggaagtagtcggccaatacgccggtctggaacagcttgaacttgccgttgtagtgggtgtcggtgttgtagtcgccgtcgcggctgtagttcaggccagagagggtgccgcggacgttgagattgtccagcactttgtagctggccatcagatcgtagccggtggtgccgagaccggcgcccactgcgaactgggcatcgtcgctctgggcgaaggcggctgcggggagggcgaggagggcgagcgcgacggcgcgttgaaacacttgcatgaaaatctttccagctgttcttgtaatgattaataaagtactaatcataaaatttcattttataaagagcctgtgaaaaatacgcttgcggcatgtgcgggaaggctccgatgccagaagcggactttgctgataacattcaactattacaaccttcaggactattggcatgaaatgcgcgttttgcggcaacgccgatacccaggtgatcgactcccgcgtcagcgaggatggggccagcatccggcggcggcgccgctgtccggtatgcgataaacgcttcactaccttcgaaacggccgatgtgcgcatgccgcaggtggtgaagaccgccggccatcgctccgagttcgatatcgagaaagtgcgcaccagcttcctgcgcgcgctgcacaagcggccggtgtccaccacgctggtggacgaagcgatagaccgcatctgccacaagctgctgcagcttggcgagcgcgaggtgagcagccggcagatcggcgagatggtgatgaacgagctggcgcggctggacaaggtggcctatgtccgcttcgcgtcggtttaccgcagtttccaggatatttccgaattcaccgatgcgatcaaggaaatccagaagtctgcgcattgacgcagccggcgcaggccgagcatgagcacggccgtcccgaggagcgccgcgccgcggcctgatgtcgcccgcggggggcgcgcatgagccgagtgggcattcgcgaggccgatccggcgcgcgacgcaccggccttgttcgccttgatggcaagcagccgtccgacgttggcgcaatggctgtccagcacggtcaggccccaatcggcggcggatatggccgccttgctgctggcgcaggcgcgcagcaaccaggaagggcgcgccgcccacaggctgattgaggtggacagcgaggtggccggcgtctgctcgctgcatggcatcaatctggcgcatggctacgcgcgcctgggctactggctggcggatcatcacgtcggcaaagggacgatgggcctcgcgttgcggctgttgctggcgtacgcgttcgacgaactgggcctgcaccggctggaactgggctgcgcgccggagaacctgcgcagctgccgtgtcgccgaacgcctgggtttcaagctggagggagagctgcgcgacgcgcaatttctcaatggccgtttctggaacatgcgttgttacggcctgttggccgatgagtggaagaatcgaacatgacggactatagcgccgacgatcacctgcacatgcagcgcgcgctgcgcctggctgaagccgccacccgccgcgccgcgcccaatcccggcgtcggctgcgtgctggtgcgcgatggcagggtgataggcgagggcgccacgctggcggtagggtcggaccacgccgaaatccaggcgatcaaggattgcctcgcccgcggcgataccccccgcggcgccaccgcctacgtgacgctggagccctgcagccaccacggacgcacgccgccgtgcgcggagcgcctggttgcggagggcgtggcgcgcgtggcggcggcgatggtcgacccctatcatgaagtggccgggcgcggcatcgccatgctgcgcgcggccggcatcgaggcatcggccgggctgatggagacggaggcgcggcgcacgcaccggggcttcctgtcgcgtgtcgaacgcggccggccgtgggtgacgctgaaggccgcggccacgctggatggcaagaccgcgttgctcaacggctgcagcaaatggatcaccggcgcgcaggcgcggctggatgtgcagcgcctgcgcgccgagaactgcgccatccttaccggcagcggcaccgtgttggccgatgacccgcaactgacggtgcgcgaggttccggtggcggcgcagccgtggcgggtggtgctggacggcgcgctgaaaaccgatcccgccagccgcatttaccagggcggacggacactgctggccagctgcgtaagcgatgccgggcggctggccgcctaccgcgagcgcggcgtggagacgctggcgctggcaggctgcgccggcgaagcggatcttggcgatctgttgcggcaactggcggcgcgcggcgtcaaccaactgatggtggaggccggcgccggcttgaatggcgccttgctgcgagccgggctggtggacgagatcgtgctgtacctggcgccgtcgctggcgggcgatgcggcgcgcggcctgttcgcctggccggcgttgaccgacctggccgacaaagtgaggctggacatcgtcgacttcggcaaggtcggcgatgatttgcgcctgatcctgcggccggcggcctgatccaccgcgcatggccgccgcccgttcgggcgcggcgtcatgtatgctggaagcaggccatgcgggatggcctgagagcgtgtccgccggggcgggatgcggttggctggagggtggcatggcggatgtggcatcggcgctgggcgcgtatctgcacctgattgaccgtttgggcgcgaaggccgaggtggtcgaacagcggcgggcgttgttgctgcgcctgctgaagcggctggagagccaggcgcgcaatgccgaagcctatcatgccgcggtagagcttttcgtcgccgattgcccgccgcgcgagcgggtgctggcgatgacctgcggccgcgaattctactgcttctggctggacgacatgaaaaaggtggtggagatcaccgcccgcaacggtttttcgctgcacaatccgcaaatgctgaatgtcggcacgttcgatcatctggtcgcgcagatgcggcaaaagcgcttccgccatttccccccttcgctgggcctgtatctgggcaagctgttcgaggacggccatcccgaggagggcatacgccagcgcgacattctgctgaaggcgctgttgttcctgctgtccccccatccctttcattccaccagctaccggatggcggtggacgccttgttgctgcacttgcaggatcgcgccgagcgccagctgctgttgccggcggtgcgcgaatactttccgtactggcaagcttttcccttcgcccggcagcgggcgcaggcggagcgggaggccggcggcgagcccggcgccgcccaggataaggcatgataaaatatcatttgatataagttttcatgtcgttttcccctttatttccatgcgcttattgtcgatcttccttgtcttgccgattatttattctcatgagaatatgttttctccattacaagggagaatgccatggggaatcagacggcctatcagagcctgacccaaactttccagcgtttgcatcgtttcggccacctgtccgcgatcgccagttgggaccaggcggcgatgatgccggccaaaggcaacgaggcgcgcgccgccgcccaggccgaattgcaggtgctgatgcaccagctgatcaccgctccggaattgaaaacgcagctggacgccgccgcacaagaagaactggacgcggcgcaacgcgccaatctgcgcgaaatcggccgcgaatggcggcaggcgaatttgctgccggccgcgttggtggaagccaaggcgctggcggcggcccgctgcgagcacgcctggcgcagccagcgcaagaacaacgactggcaggggtttctgcctaatttccgcgaggtgctgcgcctggcgcgagaagaggcgacgctgctggcggaggcgacaggcgtcagccgctacgacgcgttgctggacaagtacgagccggggatgaccagcgccaatctggagcgcattttcggcgacgtcaaaacctggctgccgggcttgatcgcccaggtgcgggacaagcagtccggcgagcgcgtgatccagccgcaaggccctttcccggtggagaagcagcgccagctgggcctggaggcgatggggctgctgggtttcgatttcgatggcggcaggctggatgtcagcagccatcctttctgcggcggcgtgccggaagatgtgcgcatcacgacccgctatcgcgacgacgatttcgtgcaaagcctgatgggcatcgtccacgaaaccgggcacgcccgctacgagcagggcctgccgcgcgactggctgccgcagccggtcggccgcgcccgctcgatgggcatccatgaaagccagagcttgtcgttcgagatgcagctgggccgcagccgcggcttcctgcaattgatcgcgccgctgatccgcaagcatttcggcgaccagccggctttcgacgccgacaacctggcgcgcctgtacacccgggtgcagcccggctacatccgcgtcgacgccgacgagctgtgctacccggcgcacgtgatcctgcgcttcgagatcgagcgggcgctgatcgacggcgagatcgaggccgaggacgtgccggcgctgtgggacgagaaaatgatggcgtatctgggcgtggatacccgcggcaactaccgcgacggctgcctgcaggacatccactggaccgataccttcggctatttccccagctataccctgggggcgatgtacgcggcgcagtatttctcggtattgcgcaagcagacgccggatctggacagccgcatcgcgaagggcgatctcgcgccggtgttcgattggctgaacgccaatatctggagccagggcagccgctggagcactgacgagctggtggcccgggccaccggcgaggcgctgaacccggcgcactaccgcgcgcatctggaagcgcgttacctgggttgaggcggtatggccggccgggccgtggcggtccggccggcgcttattcgccgcgcagcaggaagcgttcgacttccgccgccatttgttccggtttttcccattgcagcatgtggccggcgccggcgatcttgacttcatccagatgggcgaagcaggagcggcgctgatccagggtgtccatcacgccgctgatcgccggatgctcgaacgagcgctctcccagcagccacagcgtcggcgcggcgatgcggcgccagcaggccatcgcttcctccagccggtacagcaccggattgaccatcttgtggcgcggatcggcgcggtagatcacgccgccgtcagccgggcgcgtcaattcagccgccagccagcgcgccctttccccggtcagcaaggggttgcgcgccatcagcttgtccgccgcctgggccggctccatcggctcgaaagccatagcctggctggtctcgcgcagccagcggccgtagcggcccggcgcctcggccggacgggtggcgccgaggccgaagccttcagccagcaccagtcgatggatccgttgcggacagacgccggcgtagatgccggcgatcatcgctcccatgctgtggcccagcaggttcaccggttgttgcggcgacagttgccgcagcagatcgtccaagtctgccaggtaatcggggaaatagtagctgccgtcattccattggctgtcgccgaagccgcgccaatccggggccgccacctgccagtcgccggccagggcgtccaccatgaattgaaaggtggccgagctgtccatccagccatgcagcagcaccagcagcggcgcctgttccggcccccagcggcggatatggcagcggcgttgattgagcgtgaggtattggctgcgggagggcttcatgatcggcggattcctgatgggcgggcatccagtgtaaacgcgcggggaacgggtgggtagcggctggagcggtgggcatgagcggatttatgcctttggctttttttgttcggtttgattttgaatttggcgttatttgaaatgttttaatttaaaatgttgtcaatgtgatgcaataatgccacatgcgagttatgtgcgaaaaatgaattttccactaatgaattcattttttatcagcatgttatgtttgtttttgccacggttttgcgggcgcgcagctgttgaagactatgggcggtttactttaaccttgcgctcaatcacttctgaaccggtagcgaaaagccttgtcgaaggctggtttgccggggggaaggcgattggcgctgagcatcgtccagccatggcatcacggtctggcgcagcttttccgcaccgaatctctggccggatttcggccaatttttaaaccatatgacgcttcagtttgaagtctttcgtttttatttgatgggctttgtttgatctgattatggttttgttgattggttgcggaaggtgggatgaattcggcgctggagcgcccgaggcgcgggcagatcgcaggactgccgaagccgctccggcgcgatgaacgacatatcaatttcagccctttcgcgagggcgagcaatcgggcagaccactgcctgcaacttcaacggagactttgtaatgaaacagatcgtaactgccgcgctgatcggactgggtttgtattccacgggcgccatggccgctgacggcaccatcaccgtcaatggaaacgtcgttgcccagacttgcacggtttccggcaatggcgccagcgccaatgtgactgtgacgctgccgaccgtcggcgcgtccgcgctggccagccaaggccaaaccgccggcgccacgccgttcaccatccgtctgagcagctgcccgtccggcctcaacaacgcccaaacccgctttgaagtgggtccgaacgtcaactcggtatccggcaacctgctgaacgccgtcggcaagacctacgcctccaacgtggaagtgcagctgctgaacaacagcttcaccgccatcaacctgaacaacaacgccaattcccagatcgtgtcgatcaacaacggctcggccacgatgaactactacgcgcagtactacgccaccggcgccgccaccgcgggttcggtgaacagctccgttcagtactcgatgacctatcagtaatcggttcggtcgtccggcggtttcttgcgaggccgccggacggttttctcgactcggaagcggattgaaaatgaaacaagcagtaaggcgagcggcgctggcgctgatgttggcgggcgcggcactgagcggcgcggcccaggcgggcgtggtgatttccggcacccgcgtggtgtacaaggcggatgaccgcgaggtgaccgtcaaggtcaacaatccgggcaaggagccctccctggtgcaggtatgggccgacagcggcaatgagaagtcggttcccgataccgccgacgcgcctttcctgatcatgccgccgattttccgcgtcgacccgaccaagggccagaccctgcggctgaccttcaccggcgccgatctgcccaaggacaaggagtcggtgttctggctgaacgtgctggatgtgccgccgttgcccaagctgaccgcggagcagcgcaatttcatgcaagtggcctttcgttcgcgcatcaagctgttttaccggcccgccgggctggcgggcacgccggacgatgccgccgacaagctttcctggactttgctgccgcaggccggcggcaaaggctatacgctgcgggccaccaacccggccgcgtaccatgtttctctgaatcgggcgattctcttgtccggcaagcatgagttcgacacggatggcggcatggtgccgccgggcggcagcaaggatttcgcgctgaaggatgcgaagttcaagccggaaggcggcctcaagctcaattacgaaagcatcaatgactacggcgctccggtgatgcatagcgcgccgctggctccctgatcctattccctgcgccagcccgcgcggcgcgctccggattctctagcgatgaagcacttgactacacggcggcacgatcgccgctgggcgctcagcccgctcagcctgttgatctgcggcctgttcggcggccaggccgcctgggccgacgcgcccgcggcggcaagcgcccctgccgacgacgtccagttcaatccggtgttcatcaatcagaactccaacggccaaaaggtggatctatcccgcttcaaccagacgggtggcgctctgcccggcaactaccgcgcggatgtctacgtcaatgatgtctggctggggcgtcgcgacgtgctgatgaaggagatggccgagcgcaaggtgctggcctgcttcaaccgcgcgatgctggacgagctgggcgtggatttcgcgcgcttgggagaaacggccgaactgcccggacgggacgagcccggccgctgcgcggatatcgccgcggtggtgccgggcgcgcgttccagtttcaacagcaccgatttgcgcctggatgtcagcctgccgcagaagtatctgcgcgcccaggcgcgcggctatgtcgcgccggaatactgggatgccggcgcgccgctggccggcttcctcaattacaacgccaatggctaccgttacgacaacggcgcctccggcaaatccacgcagttctatttcggcgccaacgccggcctcaacgtcggcttgtggcggctgcgctacgacggcgcgctgacgcaacagaacagcggcaacggccaaagccagcgcaactaccagcacgcctcgacttatgttcagcgcgacatcaccggctggcgttcggtgttgaccgtgggcgactacttcaccccgtccgacctgttcggcagcgtggccttccgcggcgtgcagctcagctccgacgaccggatgcagccggagtcgctgcagggctatgcgccggtggtgcgcggcgtggccgagaccaatgccaaggtatcgatccgccagaacggcaacctgatctacgaaaacgcggtgccgccgggcgagttcagcatcgacgacctctacaacaccggtttcgccggcgatctggaagtgactgtagccgaagcggacggccgcgtgcgcaaattcgtggtgccttacgcggcggtgccgcagctgctgcgcgacggccagtcgcgctatgccgtgatggccggacaatggcgcggcgcctccttgagcaagcttcccgtcttcgcgcaggcaacctaccagcgcggcatcagcaacggcctgaccttgtatggcggcctgatcgcggcagaccattaccaatccgcgctgttcggctccggcatcaatacgccgctgggcgcgctggcgctggatgtgacgcagtcgtgggcgagcggcttgccttacggcggggcggacagcgatatgcagggccaaagctaccgggtcacctacagcaagctgatcgaatccacccgcaccaatttcacggtggcagcgtatcgcttttccaccgccggttttctcgaactgggcgactacgtcaacctgatcaaccagcagggcgcggtcttccgcgccaagaacaaattccagctcaacgccgaccaggccctggccaagggctggggacatatcttcatggccggctcgtcgcaggattactggaatcagcaagggcgagatctgacctatcaactgggctacggcaacagtttccagtcagtgagcttcaacctgagcgcgggccggactcacgatgctagcggacgcaatatcaatcagtacatgctaagcgtatcgatgccgctggggcgcgagccttatgcgccgctgttgagcgccagcgcgagcagcagcagcgaccgcagcgccagcgggcagctcagcttgagcggctcggccggcgagctgcgcaatctcagctacaacctgtacgccaataccagccgcaacagcgcgggcggcaacagcagcggcggcggcggcagcgtgcagtacgccagctcgatcgccacgcttaccgcgggggccagctccggcggcggttcgtcgcaagccaatgtcggcttgagcggcgcgctggtgttccatcccgggggggtgacggcggcgcagtcgctgggcgaatccttcgcggtggtggaggcgccgggcgctgagggcgcggcggtcagcaataccagcggcgtgcgcgtcaatagccgaggctacgcggtggtgtccagtttgatgccgtatcgccagaacgaaatcacgctggaccccaagggcatgagccaggatgtggaactgcaggaaaccagcgtgcaggacgcgccgcgcgcaggcgccatcgtcatgctgaagttcaacacccagcagggcaagccggtgatcgtgacgctgcggcgggcggacggcagccatttgccggtgggggccaccattgccgccgacggcggcgaagacgcgcgcgccatggtggggcagggcgggcgcgccttcctgcgcgggctggagggcaagccgctggtggcgcgctggggcggcgaaccggaccagcgctgccatttccgttacgcgctcccgcaagcgacaggcggagcggcgtatctgcagatggacgcggtctgcgcgccgcaatgatattcaaccgtggcggcatcgcccgtcgggaaacgatgacaatgaaaaaatggatcactcagggattgcgcggatggttgctggcgctgtgtttggccatgccgctgaccagccatgcgctgggttgctggaatggcgacgacggctcgggcggcgtgacgtcgaccttcaacctgcccggcaatctgtacgtcgccgccaatgcgccggcaggcaccatcatctggcagtcgccgctgcagaacctcaaactgtattgcacgcagagcataggcgaaaacgtgtatttctgggtgaacccgcaaagccaggcgctggcgccgggcttgcagatcggcatcctgttcaagggccggacctatacccagagcagcggcgccatcgataccggcatctatgtgccgtggaacggctggatcaataccacgctgcagtactccatcgtgttgctgaagacctccggcgcgccttccagcggcaccgccacggtcagccagtactcggtgttccaattggacggcatcggcgggatcaacgccacgcccaatatcaacttcaaccagctgatcaacggcacggtcacctttacccccggcggcacttgcaatctgagcgcgaacggccagtacacggtcaatctgccgactgtcggcagcggccagttcgcggcggtgggcagcgcggcggcccgcaccggcttcaccatcagggccaccgattgttcggatggcgtgaagacggccaccttccgtttttccggcgcgcaggacaagaacaacgcggtgttgttcgccaatagcggctcggcgcgcggcgtggcgatcaatctggggagttcggacgatggcgcgaatatcggcgccaacaagaccaacaatacccgggtagtcaatgtgcagtcgaagtcggcgcagctggggctgttcgtcgagtacatgcgaacggccgccattgtgccgggcagcctgcaaaccgcgattacgatagacatgttgtaccaatgacctggcgccgccgcgcccggaacgcaaaaaagccttcggccgtttggccgaaggcttttttgtcagtgttcggatcagttgtaaacgatggtaaccagttggccgctggcggaggcggtggcgcctgccatattgaccgaggaaacgctcagcgactgggtgctgtccatgccggagcaggcattgccggacgcgatcttgcgggcggcctggtattggcgcggattcgtcgcgtagctcagcagcgtgctgccagcctcggcgcacggttccttgacgatggagccattgaagtaaacggtgccgccgtcggaggccagagccaagccagattgcagagccgccagcgctgccagggtgatgatgacttttttcatttgggcctcccgggttgggtgatttcgttctgagtggaattgttacgaaatctttaaaccaaaaatttaaattaattcggtttatatgtaaccgcttctgttaagccaagtataggcggccatattgtaaacagcaacacctggttttattgaattattaataataaaaattaaacaataacgatgacctgccggcagcgcgaggaggctgcggccagcgggggaccggaggcggtttgaccggagataatttcaacttattgcatttttccgggatcgcctggttttgtggcggcaggcgccgaatgaaggggatccgaggggagggtgtggcggaaatgaaaagccccctcgctaggagggggctgcggcgggcgcgagtttcagtgtttatggatgtcgttgcggaaggtttcgcgcagaaacagcaggctcaccaccaggctgacgccgtagacgatgatcggataccacaggccgtagaggatgtcgccggtgtacaccaccagcgagaacgccaccgtgggcatcaggccgccgatccagccgttgcccaggtgatagggcagcgacatcgaggtatagcggatgcgggtgggaaacagttccaccatcatcgccgccagcgggccgtaggtcagcgccgaaatcaccgacagcagcaccagcaccagaatcaccatcaggtggttgatcttggccggatcggccttttccggatagccggcctgtttcaggccgtcttgcagcgctttcttgtcgaagccctgcagcaccgtcgcgccgatgtggatttcggtcacgccggcggcggccgcttgttgctggtagggcacgccgttcttcgccagcagcgtcttggcctggtcgcacggagtgttgagcttggccttgccgatggggtcgaactggaagtggcagctggcggggtcggccaccaccgtcaccggcgcgctggcctgggcggcggcgacgtccgggttggcgtagtcggtcagccagcggaaggcggggaaggtgaggatgaggcccagcaccaggccggcgatcagcaccggtttgcggccgacgcggtcggacaggtggccgaagtacaggaacagcggcgtggtgacgatcagagacgcgatcagcatcaggttggcggtctgcgggtccactttcaggatctgcgtcaggaagaacagcgaatagaactgcgcgcagtaaaaggtgaccgcctggccgccgttgaagccgaacagcgagatcagcacgatcttcagattgctccagttgccgaaggcttcgctgatcggcgccttggagtgcttgccttccgccttcattttcaggaaggccggcgattcctgcatcgacagccggatccaggtggaaatggccagcaggaagatggacagcaggaagggcaggcgccagccccagtcgttgaaggcgtcgccggtcagcttgcggcaggccaggatcaccagcagcgacagcaacaggccggcgccggcggtggtctgaatccagctggtgtagccgccgcgcttgtggtcgggcgcatgctcggccacatagatcgcggcgccgccgtattcgccgcctatcgccaggccctgcaacatgcgcagcgacaccaggatcagcggcgcggcgatgcccagcgtcgaataaccgggcaacacgcccaccaggaaggtggacaggcccatgatgacgatggtggcgaggaaggtgtacttgcggcccaccatgtcgccgaggcggccgaataccagcgcgccgaacggccgcaccaggaagccggcggcgaaggtcagcagcgcgaagatgaaggcggtggtttcgttgacgccggtgaagaactgcttgccgatgatggcggccatcgcgccgtacaggaagaagtcgtaccactcgaaaaccgtgcctagcgacgaggccagaatcaccttgcgctcggcgcggctgatgccggctgcgccggcggccgacgatgcgatgctgttgctcatgccgaagtctcctttgctggggtggccggcgtcgcgaacgcgcccggctgtttgttgtcctgcgcgatcatctgcgccgccttggcggcgatcatcagggtggggctgttggtgttgccggaggtgatggtaggcatgatggacgcgtcggccacccttaggccggcgatgccgcgcacccgcagccgggcgtcgaccacggccagcgggtcgttgcccatcttgcaggtgccgaccgggtggaagatggtggtgccgatctggccggcggcctccaccagttcgtcttcggtctgatagcggaggccgggccggtattccgccggcaggtagcgcgacagcgccggcgacgcggcgatgcggcgcgtcagccggatggcggcggcggcggcgcgctggtcttccgggtggctgagataattgggctggatcaagggcggcgcgtcgagcggcgcgccgcccagctcgacatggccgcggctatgcggccgcagctggcagaccgaggcggtgaaggcgggaaacgggtgcagcggctggccgaagcgttccagcgacagcggctgcacgtggtattccaggtcgggccagcgcacgtccggcgcgctgcgggcgaaggcgcccaactggctgggcgccatggccatgggtccgctgcgccgccacaggtattcccaggccatcgccagcttgccgcgccagctggctgcgcgctggttcagcgtgggcgcgcccgctatctggaataccagccgcagctgcaggtggtcctgcagattggcgccgacgccgggcaggatgtggcgcggcgcgatgccgcattcggccagcaagcgggccgggccgatgccgctgcgctgcagcaaaagcggcgagccgatggcgccggcggcgaggatgatttcgccgcggcagcgcgcttgcagtcgctgcccctgttgcaaaaaggagattgcgcgggcgcgctgacgttcgacgaccaggctttccgcctcggcgccggtcagcactgtgagattggggcgatggcggacagggtgcaggaaggcgcgcgcgctgctccagcggcggccgtttttctggttcacttcgaaatagccgcagccggcattgtcgccgcggttgaagtcgtctaccggcgcgatgccctgctcggcggcggcggcgcggaaggcgtcgaggatctcccacgacagccgctgcttgtccacccgccattcgccgccgtggccgtgtaagggccgcgccgggtcgaaatggtcttccatcgcgatgaagtggggcagcgcgtcgcgccagccccagccgggattgcccagcgcttcccagtggtcgtaatcggccgcctggccgcgcatgtagatcatgccgttgatcgacgaggagccgcccagcaccttgccgcgcgggtagcccagcgcgcggccgcccagcccgctttccgccgcggtctgatagcaccagtcggtgcgcgggttgccgatgcagtagaggtagcccaccgggatgtggatccacgggtagtcgtcgttgccgccggcttccagcagcagcaaccgcttgtcggcgtcggcggacagccggttggccagcaggcagccggcgctgccggcgccgacgatgatgtaatcgaactccccgctcaacatgccgccacgcccattcatgtcgttgtcgtagcagccatctaaactgaagcggggctggctgggaatagccagcgggaaacaacgtatgttaattttttaacaacaggcggcgtgattggcgcgctattcgtgtgcaaacgcacaatgaccatccggatgcgacgatgttcgactggaacgatgtccgttattttctggcgctgcagcgcagcggcaaactgctgggcgcggcgcgccagctcggcaccacccacgccacggtggcgcgccacatcgccgcgctggaggcggtgctgggccagccgctgttcatccagcaggccgacggctacacgctgaccgccgccggccgtcagctgctgccgctggccgaagcgctggagaacaccgcttcgcagatgctggacagcggctgcaaggggcatgccgaagtcagcggcgtggtgagggtgggcgcgccggaggggttgggcgcgttgtttttggcgcgccacatgccggccttgatggcgcggtatcccgggctggagatcgatctggtggcggtgccgcgctttgtcagcatcaccagccgcgaggtggacatcgccatcgcgctggagcggccgcaggccaatctggtggtgacgcgcaagctgaccaattactgcctgggcctgtacgcgacgccgggctatctggccgggcatccgcctatcgccgagcgcgaagacctgaacggccacgccatcctcgcctatgtcgacgacctgctgttcacccgcgaattgatgtaccaccacggcctgtgtcgccatccgcgcatgcctttgcgcaataccagcgtggtggcgcaaaaggaggcggcgctggcgggcggcggcatcgcggtgctgccttattacatggtttacgacgatgcgcggctggtgcaggttttgccggaattgcgcatcgtccgttcgtactggatcagcgcgcgcagcaacatccgccgcacgctgcgctaccgcgtggtatgggattacgtggtggatttgtgccagcgcatgcaatggctgctgttgcaacagccaactcagcaaaacgaatcaatcgatgcgggataagctcacttcatgagaacgctctatcgcaacggcggcccggattcgccgtatttgtggcggatgctgcgggcgctggactacctgtggcgccatctggacgggccgctgccgctggaaaggttggcggaggaggcctgcttgtcgccctttcactttcaccgcgtgtatcgcggcctgatggctgaaacggtgggagagacccggcagcggctgttgctgcaccgcgcggccggacagttggacggcggctcgctgcctttgtctaaggtggcggcgcgcgccggctacggcggcaccgcggccttcgtcagggccttcgccagggcttacggcgagagtccgggccgctaccgccagcgcagagcgttcatttctaggcaagactgggagaccgtgatgcatgaagtgacattgctcaaacaggataaggggctgacggtgctgatgcgccgccatgccggcagttatatggagatcggccaggccttcggcgccttgcaggccatcagcccggcttgcgcagtcggcgacgcgccaggccgcgcattcggaatatatctggatgatccggagcagacggaagaggccaagctgcgcgccatcgcctgcgtgacggtgccggatgcctggcagggcggccgctgccggatgggtttgagtggggagagattcccgccggagagtacgcttgcgtgacgcatcagggaccgtacgcggagctgtccacggcctggtcctggttgtaccggcactggctgcccggcagcgggcgcgcgcccggcggcgtgccgtgcgtggaagaatatttgaattcgccgtacgacaatccgcccaccgccttgcgcacccggctgatgttgtcgctggcctgactggccggcgcgcaaaaaaagcccgcgttgcgcaacgcgggcttttgttcgaccaggcgaaaccagcttagcggtcgacgtggtagttcggcgcttccttggtgatctgcacgtcgtggacgtgcgattcgcggatgccggccgaagtgatttcgacgaactgcgccttttcgtgcaggtcggcgatggtcgggcagcccaggtagcccatcgacgagcgcaggccgcccaccaactggtggatcacctggccgatcgggcccttgtacggcacgcggccttcaatgccttccggcacgaatttgtcggcggcgttggagctgtcctggaagtagcggtctgccgagccctggctcatcgcgcccagcgagcccatgccgcggtaggacttgtacgaacggccctggaacagttccacctcgcccggcgcttcttcggtgccggcgaacatgccgcccagcatcaccgcgttgccgcctgccgccagcgccttggcgatgtcgccggagaagcggatgccgccgtcggcgatcatcggcacgccggtgcccttcagcgcttcggacacattgtggatggcggtcagctgcggcacgcccacgccggccacgatgcgggtggtgcagatcgagccggggccgatgccgaccttgacgccgtcggcgccggccttgaccaggtccagcgccgcctgggcggtggcgatgttgccgccgatcacgtcgacttgcgggtaggtttgcttgacccagcgcacgcggtccagcacgccctggctgtggccgtgggcggtgtcgaccacgatcacgtcgacgccggccgccaccagcgcggctacgcgcgcctcggtgtcggcgccggtaccgacggcagcgcctacgcgcagacggccttggctatccttgttggcgttcgggtgttcgctggtcttgatgatgtccttgaccgtgatcaggcccttcagctcccaggcgtcgttgatcaccagcacgcgctccaggcggtgggtgtgcatcagctcgcgggcttcgtcgatgctggcgccttccttgacggtgatcaggcgctcgcgcggggtcatgatggagccgacggtctggtccagacgggtttcgaagcgcaggtcgcggttggtgacgatgcccaccactttgccggcttcgatcaccggcaggccggaaatcttgtattggcgggtcagcagcaccaggtcgcgcaccagcatgtccggggcgatggtgatcggatccttcaccacgccgctttcatggcgcttcaccttggagacctcggcggcctgtttttcggcgttcatgtttttgtgcacgatgccgatgccgccttcctgcgccatggcgatggcgaggcgagcttcggtcacggtgtccatggcggcggaaaccagcggcagcttcagcgtgatgttgcgggtgaactgagtggtcagggtaacgtcgcgcggaagaacttccgagtgggctgggacgaggagaacgtcgtcgaaagtataggctttctcgatgatacgcatcttcgcgtttccttaggcggcaaagcggcattataccgaatcatgcggcgcactgcaaaaagagcgcgaagattcgcgctttttgcgcggcgctgggccaggccttacaatcggcggcaccgggaccaagcttggggatgccaatcatgcagtcatctatagtatggacgtttttgctggcattgctattgccgggcgccgccgcggccgaggtctatacctggaccgacgccaacggcaagaccgtgtattccgaccagccgccgccgcatgtcaacgcccgcaagctgaatgtgcgcgcgcagcggccagccggcgcgtcggcgccgaaggcggagaagaaggccgacagcaagccggccgccaacaagcaggtggcgtccgacaacgccgccgtcgccgccgccaatgccaaggtcaaagcgcagaactgcagcgcggcgcaggccaatctggccactttgcagcaaaacggccgcatccgcatgcccggttccaccgcgctggccaccgacgcccagcgcaacgagctgattcgtcaggcccagaaggatgttcaaacctggtgcaataaataagtgtccaaacccgaattcgactaccagaacgtattgcagaacctgccggccttgcccggcgtctaccggatgttggatgccgagggcaaggtgctgtatgtcggcaaggcgatagacctgaagcgccgcgtcagctcgtatttccagaagaacgacctgtcgccgcgcattcggctgatggtgcggcagatcgccagcatagaaaccacggtcacccgctccgaggccgaggcgctgatcctggagaacaacctgatcaaggcgctggcgccgcgctacaacatcttgttccgcgacgacaagtcctatccctacctgatgctgagcgggcacgatttcccgcagatggcttattaccgcggcgagccgaagaagcccagccagtatttcggcccttatcccaacggctacgcggtgcgcgaaagcattcagatcctgcagaaggtgttccggctgcgcacctgcgaggacgcggtgttcgccaaccgctcccgcccctgtctgctgtaccagatcaagcgctgctccggcccgtgcgtcgagcatatttcccgcgacgaatacgcggccgatgtcgccagcgctgtggcttttctcagcggcaggcagagcgagctgatagaggagctgaaccggcgcatgatggcggccgccgactcgatggagtttgaacaggccgccgagctgcgcgatcagatccaggcgttgtcgcgggtgcaggaaaagcagttcgtctccagcaaccagagccagcaggattgcgacgtggtggccgcggtgctgaaggatggcatgccttgcgtcaatctggtgatggtgcgcggcggccgccatctgggcgacaagagccacttcccggtgggcggcgaggccgataccgcgcaggaaatcctggaggctttcctggcgcagcattatctgaccgccggcgtgccgccggccttgctggtgaacggccaattgagcgacgctttgcacgaattcctgcagcagcaggccggacgcaaactggcgatcgccagcaatccgataggcgagcggcgagtgtggctggaaatggcggagaagaatgccgaactggccatcctgcagcggcagggcagcaaggccacccagacccagcggctggcgaagctgaacgaggcgctggaactggacgacgccggccgtttcgaatgcttcgacatcagccacaccatgggcgaagccacggtcgcctcttgcgtggtgtacgacaagggcgcgatgcagccgtcggaataccgccgtttcaacatcaccaccgccaagcccggcgacgattacgcggcgatgcgcgaagtgctgtcgcgccgctatggcaaactggcggacggcgaaggcaaactgccggacgcggtattcatcgacggcggcaagggccaggtgggggtggcgctggaggtgctggcggaactggggctggccttgcccatcgtcggcatcgccaagggcgaggagcgcaagccgggtctggaaacgctgatcctgccatacttggaaaagacgttacaattgcgccaggaccatccggcgctgcacctgatccagaccgtgcgcgacgaggcccaccgcttcgccatcaccggccaccgcgcccggcgtgccaaggcgcgcaccgcctccacgctggaagagatacccggcatcggagccaagcggcgccagcagctcttgatgcgcttcggcggtttgcgcggggtggcggcggccaatgtcgatgatttgtgccaggtggaaggcatcagcaggacgctggcggaaaagatctacaatgccctgcattgattgaatgactgaaagcggcgggcttccctgattcaggctcgggatggccgccggcgatgtttacgagcctgattgcgacaagaccaaaaccaatgcccttcaatttgccgatattcctcacctggctccgggttgccctgatcccgatctgcgtggcggtatttttcctgccggactccattctgttgctgcacagccgcaacgtcgtgggggccggcattttcgcattggcggccgccaccgactggctggacggctatcttgcccgcaagctggggcagacctcggcgttcggcgccttcctcgatccggtggcggacaagttgatcgtggccgccgcgctgatcctgctggtgcagctgggccgcaccgagggctggatggcgatgatcatcatcggccgcgagatcaccatctcggcgctgcgcgagtggatggccggcatggggacgcgcggcagcgtcgcggtagcttatatcggcaagctgaaaaccgccgcgcaaatgctggcgattaccctgctgctgtacgatggcgcgttgattccgggcctgaatgcgcgaatcgcaggaaatttttccatgtatatcgcggtgattttgactttatggtcaatggtttactatctgcgcatggccgccaaagagtttgccggcaaaaaaatcgatgtttgaagtgttgacaggcctgaataaatctctataattcgcagtctctcgccgctactgacgaagcagcagcgagatgcagtagaaagttttgcaagtttcagcggtgcgggaatagctcagttggtagagcgcaaccttgccaaggttgaggtcgcgagttcgagcctcgtttcccgctccaaacaaatttgcaagcatgcgacgcgggaatagctcagttggtagagcgcaaccttgccaaggttgaggtcgcgagttcgagcctcgtttcccgctccacccctttcactgcagattgttttatgcgacgcgggaatagctcagttggtagagcgcaaccttgccaaggttgaggtcgcgagttcgagcctcgtttcccgctccaaacaaatttgcaagcatgcgacgcgggaatagctcagttggtagagcgcaaccttgccaaggttgaggtcgcgagttcgagcctcgtttcccgctccaaacaaatttgcaagcatgcgacgcgggaatagctcagttggtagagcgcaaccttgccaaggttgaggtcgcgagttcgagcctcgtttcccgctccatctacaatccaggttttacccatgcgggaatagctcagttggtagagcgcaaccttgccaaggttgaggtcgcgagttcgagcctcgtttcccgctccaaatttttgttgaccagtttatgcaaattggttagagttgcaaatggcggggtagcaaagtggttatgcagcggattgcaaatccgtctacgccggttcgattccgacccccgcctccagatttaagcccgtaaatccaaggatttacgggctttttccattgtattcccttaagccctcaccctgtcaaaacggcggtaatcctgcactttcccgcccttaaccactcgtaaagatggcggaaccactcgtagaataacagtttgttaatctacgtgagttgcaccatggccacaaaacgccaacggactagcggttcctgggagttcatcgtccggcgcaaagggctattgccgaagcccgtatccttcacgttcgacagcgaggcagagggcgacgcctactgcgccaggctggaagcgctgctggaccgtggcatcatcccggccgatcttgtcgacgagcggcccgcaatcgccaccatccgcgatgcgctgcgcatgtaccaggccagcgtggcgctggtggatagcgataagcaagttcaagcggcactggtagacaaggtgggcgaggttctgatgcgcaatgtctgctacacctgggcggaaagctgggtgcgggacatgaagcaagttgagaagctggcgccgtccaccatcagaatctatgtggggtcgctggcgcgctgtttcgactacctgacgcgcctgcctgatagcactttcgttaccaacccgctgcggctgctgccaaaacgctacgcgacatataccgacgccgacgccgcggtgctgcgcgccagcgcgaaagagggcgaggcggtagaggtgccgaccaacaccgagcgagaccggcgcctcctggaggcagaggaggcggcaattcgccgaatcctcgatggatgcaaaccagacggcaagcagaggccgcttgcctgcgcctggcgtggtgcgcttgagctgatgttggagctggcgctggaaacggcaatgcggatgcgcgagatttacacgctgacgctcgaccagatcgacatggagcggcgaaccattttcttggacaagaccaagaatggcgacaagcgacaggtgcctttgtccagcgtggcactggcggcactcgtgcgctaccgcgagcaggtagcggccggcgagcgcgatatgtcaggctggaaccatgagggcgacaggttgttgccgtggtggagtggcgccaatagccccgacgtgctgcggaagaccaccgcgctactgtcgcgccagtacgcgcggatttttgaggcggccggctgcggtgatctgcgcttccacgatctgcgccatgaagcgacgtgccggtttttcctgaaaacaaaactgtccgacctgcaaatcgccaaaatcaccggccacaaagacccgcgaatgctggctcgctatgccaatctgcgcggcagcgagctggccgatcagctctggtaatgcaaaacgccccggctggggcgttttcaatttcagcactttggccgatctacagtctcggcgcaccctgtttgcggttgtaccgctgtcatgcattcctcctcgtataccatgagcaatacctcctcaacggtaacgcccccgtagttaccaccagccttcgacatggccgacgccgtaaactcgccatcgtcgtccattccccatccagtaggattgtaaacagtgaacggccgggtggatttgatctgttcgcagttacaagccgcgatacctatacggacatagctctcgatttgctccggcgtcattccggccactgcgctgtggtctgggtttaccttttcataaacaattgtcttcatgccgctttctccactaaatccagattggggtgctcgcgacggcgggcgcttcgcacgccagcagcgccggcggctgttttgactcgctccgttttgcggctctggccttccgtccggacagcatccgccattgcccgacgtgcattggtctggcggcggatttcgtcgcgtaggtaggtcagcacgtcatcgcgcaggaacacccaaccctggccaattttgcagcctggcagcacgccagcatctgccagctggcgcgcggtttcggtgccgatgttcagcgcggttgccgcatcatcaagagtcatcgtgtcgtttgtcatggtcattttccttattgtgctggcggccataggcgagcggcctggccggttttcagaggacggcgcccaattggtcggatgggctggccgctcgcctatggccgcggtgcggcgggttgttcagataccttccaccaccagctccaggctggtgcgttcgtcgccggcggccagaatttggaaccgctcccggccctgggcgtcgcggccgttcgggacgagctggcgctccagggcgttgccggccagcgccagggcgtagtgctgcattggcatcacctcgatggacaggcgcaggacgatgaacgggacatagccggcgccggcctgagcctcagcgttcatttcgacatcgcgcagtcggcgcgccatgcgctcggcgcgttcgatgttgcgtagctggctattcacggcgtccagctcggcgcgatagcggccgttggcggccatcatcagccgggtgtagaggttggtttgcacttccattgcggcggtgttcatcgcggttgctcctgttcgttggtatttttcttcaatgccagctcgctcattcgcgccaccagctcgctataccgttgttcagctggttcaaagtgcttggtcagcgcactgcgggctagctctaattcgccgtcctgcagaaatctgcaaaccaccaccgcgctgctggtgcgttcgcttttcacctcctcaaggtccgaaagcaatgccgttaaaagttcggtccggtttggttcattcatgcgtcctcctcgccgctcagatgcggcctgcttggttgatccattgccgcgccctggcggtagcctgggcgagctgctgggaaacggtgatgccaggcccgtggcgctcggtgctgctggcgcgggcagggcgggcggcgcgctcggcgcgggcggcttccgcctgggcgcgcacctgggaaatcacggcgatgccggcgcggtgcgtcagcccaaggttggccgccagccggctgttggcacgctgcaagcgcacgcgctcgatactggcttcgcgctggcgctgggcgtccagctcggcggcctcgatgccgcgcttggcccactcgtggacgaattcggggaatgcccgcagatagcgctgatgggcgtcccactcgcggcgcgcggccagctgctcggcggtgagcagttcgctgtcgtcgtcctcgacattcgcctgaatccggtctgccgtgccgaacatccattcgggctgggccggcgctgccggcggcacttccaaaaacgtagagttattgacacgagtccaaggggcggcggcgccgccctcaaccccgtcagccttgcggccgatgcgccattcgtggacgcgggtttgtgcgaattggccgctttcgcgctccaccacgccgcgcacctggcgctggccatcctcgccgtaacggttctctgccggctcgctgtcgcgggccacgcccagcggcatggcggcgcgcttgatggcgtggccgcccatcaggtggacgaagcgcccccagttgccggtatcggcggcgatggcggcatgcatcagcacgtcttcggcgtcggcggcctgatagtcccagcggcgcagctcgcgccacacgcccaccggcgggccgcccacttgctggaactggcgaatgccccaggtgctggcccaggcatccacgcggcgcgcggtaacggtggcgtcggtggcggcggattggtccttgctcgcgccgtcgtccttgccggcctggccggcgtggtcctgggcttcaaagtcgatgcccacgctgtcgccgttgtgcttggcgccgtccacgtttttggcgatgtacttggcgatgtagccggcggcggtgccgcgcttccagtcgatggcctcgaatgccacgcgcgccttgatgcccttccacacccagcggggaggattggcccagaagtcggcctcgttgccgatcctggcggcgatgtcggccagcaagcccttggcgccggcggcgcgcaactggcgcgcggcggccatggcttcgcccttggtttgcaggtagttcagccccagctcggcgcggtcttcgcgcacggcatagcgggcgacgatggcgcggaatttcttgaccttgtccttggccatgaacagcagcgcatgcaagtgcggcgtgccgtcgtggtgcggctccgccacgcggaagccgaacggcgcgatgccggcgcgcgccatggcggcggtaatgcgtgaccacacgccgcccaggtagtcgcgggtgtcgattggcgttttgccggcgtacttggcattgcgccggccgctcttggcgtggcgcgggtggtatttgctcggcgacgtaatggtgatgaactcgccggcgtactccaggccgacggcgatatgctcgaaaccggcaatgcggaccatcagctcggcgcggcggatggtgggattgctgacgctcagctccgacagctgctgcagcgtgtattcctggcccagctcgttgatggcggccatcgcctccagcaagccgcggttgcggcgcttttgctcgcggcggcgggcgatggcgtcatggctggcatacaggccatggcggcgatgcaccaggcccagctggatagacaggtgttcgctatggcgggcattggtccggcgcagcgcgcggcgccaccacaggctgcacgccacgcgggcggcccggcctgccttggttttgccgcttggcggggcgactccgtaacgggcgcagtacttctccaactgctcaatgttcgcgccgcggccgatcagctggtccgcctcgaacgcgcgctgcttcgcaaactccaccagttccatttcgcacgcgcccaagggcaaggcgtggcgaggcatgaacgcggtgaggtcgcgtagccattggtccgcctcccgctggcggacatcgtcctgccagggcagcagcgccagcggccggccgcgtcgctcgcaccactcgcggccgatggctcggctcaggtggcgcgggaaacggtccagcagcgggaggcgggattgccaagtcatgccgcttgcccccgcaccgcctgcggctcggcatgcaagggcaggccgccgcgcgcgagccggacttcggccaaattgctttcgtccagcatcgtttcgatgtcgtaccacatcctgcccggctgctgcatgaacagcgcgcgcagccccagcccatgcatggcgatcaactggttgatttttgcttccgtttccgccagcgtttgaatggcatcttggatttgcgccagcgcatctttccgaatcgcgtttagcaccttggcttgcagcgactcgaccgactccagcatcgggcggcgggcttgcgcctggcgctcatccatgcgggccagcgcctgcatggcgatgtcgcgcggcgctaccggcgccagcggcgcgcggcacaggtcgcccagggctggcatcacatggcgggcaaagtcctcgccgtattcgtagttttcacgggcttccatgtcgcacctcacgccggcagatacagctgaagcaggatcagcgacagcatgaacagcgccgcgcccaggtactccagccattcgcgacggctgctgaactggcgcaggcggccggcggcatagccagcggaatagcaggcggcgccattgctgaagcggacgtagcgcatcttgcggacgcgcagcgcggcgagctgttgcggggcggcggcgggctgttgcatgtcgttctcctttggggtgctgcgttttttgggcgtaaaaagccccctcgcactgcgcggtgcgattttttggggcgggtgcttcggaggaactagcctagggagcggctagaaaagtgaaatttgattatcgggctcacgtctggcccgctgccggtagtggttcattgcctcttggcggcgagcggccggggattgtggcaacttggctcggtgcatgctggcaggcaacagcccttcaaccatccagtccagccattccatcaccccgcgtggctgagttccgcagactttgcagatggcgtagatttcacgcgtggccggggtctgctccctgctggttcgaatggtaagggcggactcgccacaggccggacaacgcattgcagtcatgactagacccccttattgcaaaagacttggaacgtcaggtgattcatctgtgtcaccttggcgcagatggcgtcgcggatggcctccaggcgctggcgttcccgcttgtccacctcgccgtcgcgggtggcttcgcgccactcacgggccaggcagcccacttcatccaccaactccatgtagacgcgctggatttccgcatcgtctaccgtgtcgatgtccggcagcggcacgaacacgccgccgctatccgccgccaccgcctcagcgaagattgacgaaccgctgaatgcctgcatctgcatcgcctcatgcacggaaaccgcctggcccttgcgctcgtacacgcggttttccagaccgtccttgctgaagcccagcgccgccgccatggcggcccagccgcccggcatggccttgcacatcgtttggtatgcggttctcaatctgtccatttgctgctcctgtccaccaaacggctgcgggttcggtggttatgccgtaagtgctttcaaggtatcttctgcccatgctgtcaggccgtgctgggccagaaagatgggaagagccacatcaacaagttcgcggcccaaattgctttccgtcatttccagcatgcaggccagctctgtgatgagcagtcgcttagccgttggcacccgaaactgaacggtttttgacttggccaccccgcgaggtccgtaaacccgctttgccttctgtgcgtttgtggacatatcggctaagatgttcgtgaatgtgaatacaaagcggatggtacttcgcgtttgcgataattgcaagcttgtttttcgcgtatgcgtagttttctgctgtcaggagtaaagaattgagcttcggtgaacgactgcgcgaagagagaaatagactaggcctgatacagtcagatgctgccaaagctggcggcgttggctttacggcctaccatacctatgaaaaaggcgacagatcgcctaacgttgaagtcctgcaaaaatggcatgaggctggctttgatgtgctgtaccttgtgacaggagttcgcaacggtgccgcactgtcaaacgaagacagcagcctcttggctgatctgaaccaggtggacgagaaggggcgcgcccttgtccgcggcctacttgaaaactacaagcgcctgtcgtagcagagcaggcatcacaaagaaaaacgcccgacattgcaccgggcgttttgcatggactcccgcctattcaagagggtccacagacaggaacaccatacccatcgacgggatagcgctgattttgacttgcttgccttcccgcgtcagcgttatcggcttgggctcgctacggtttttctcaacattgcgcgtcagcttgcgcatcgcaccggtgaaccaatctatcgcattgtcctttttgccattccattgaggaaaggtgttggcaagaatcccggccgcgtaaacggcattctccaagactgccgcctggtcgtcgtttggcacgccgaacatcagcgtatatcgggacagatcgcttggatcgcctatcgcctccagcgtcataatgggattgatggtcaacagctcccggcgcgtgccatcccgcagcggcgagtctgtgcgctgctttatctcgatatcgccaaccagcttcgacgcagacatgccgagagtctttggcggcgtcttttctgccggcggagctgcggcaggcttaggcgcttctaccggcttagcctccggtttgaccgttggcgcagccaccttatcagcctccgctttttgggctatggcctcgaccttttcaggcttcttaggcggggtgggcagcatggaacctgctgtcattacgaaggcgaacacggaggcaatcagccccaagggcaccactacaaagccgcgatattccttagaacgcaaccatttagtaagcagcttccagaccagcacggcaacggccagacccacgattaaaatgagaaagtctttcatcacgaaggcatttgtttgttattgggatttgcattttacatttttagctatttgtattcacatttgagctacatgtgctgaacaaattgctagtcatgcacgccttcggtcatgaagtgctgatagctgtgatgcaacgtagcggcgtaggcgctacgcattcccacaaaaaaagcacctccaagcaagtggtgcttttcattgcgctgacgaatgaatgaagtacacaagcccacccggagacagggggccagccgatgaccgctaagccctaagctcgttcagtgctgcccgtgccaagaagcccgagcggctttcgtactcggtgtgcgtctccacaaacgcatcgatgcggcggatcagattagatggcagcgtgacgtttaccttggtggccttgcccaggtagcggacgatatccacctccaccaccgcccagatatagccctggaattccggcaggccgacatggtcggccacctggctggcggtggggatgtcggcgccgtcctcgtccagcccttcaagatggaagtcgatagcctcgcgcgcattgcggatggcctcgtcgatggagtcgccggcggagaagcagccgggcaagtctggcacggtgacgccgtaggcgtggtcggcgtcgcctggctcaatggcgataggaaataacatggtggttcctcttggtggcggatgtctggccggaaagccagcccttgcgggccggctctgttttacttcaatccagcttgtttcagcatgctgttccacgttccgattttgtaatctttggtggggtgcttgactgtcacgcggccgggtttgctggggtgcttgaactggtggtggctgcccttgcaggctacttcaaaccatccatcagctcttagcaacctgatgaattcccgactatccatccgccttcctgcgttgttgttgatggggttactataaccccggtgtggcttgctgtcaataactccggggttatttgcggcgagagggcaaaagaaaagcccccgaatttcgggggcttgttcatccccatgaaatggggaacgattcgaatctactgcatcaattggttcaaccacgcaatcgctgggaacggctgctttgtgtagcgccgtctggttcatccctgcctgtgcagggaactacttaccgatcgccatctactgcggttcaaccccgcgacgcggggaaaggttgctgtataccagcgcctactggttcatccccggcaacagggaacgatgccatcatgcgctcgtcatcgccggtcgtcaactccggccgcagataaggccggaccaatgccagcgcatcggcgaatctgttgtatggtcgcgtggcgctgctccggcagcccaagccaagccggctggctgcctccgccggcgtcagaccttcaaccgcaaccagacgcgcggcctcgcgcccctggccaccaatgcctgccacggtggccaacgcctcgaacagctcaggcgctaccattgcgcagctctcccagcgccaccgccaccgcgtacaactcacccatggcaatggggcggaatttgcggttttccggactgacgcgccagccgagaatctggctattgctgacgggcagacccacccgccgcagcacaccggccagctcgctgtcgcggacctcgcgcagcaatcccttgtacacgtcgttcaactgcgcccggcccaattccagcgcctcggcatccaccccggcggcaagcaaggcttggcgcacgtcggccagcgcggcctgcggcagatccagcgcggcagcggctgcatccgctcggccatcgaccggaatctcgtacagtgtgcggccgttgcgctccagaatcgccaacggccggctggcgcgcagatcgccgcgcagcagcagcgcgcggaacgcggcggcggcgatgagtgggtcgcggacggtcgccaactcctcctcgcgcccgcccgactctagcaagattttgtattcgtccaacgtaaacccctcaggacaaagccccgccgactggcggggcgattgttcatcacatggccggcagactccagctgctggcggcaatagccgccaaacgcgcagccagccggtcctccatttccgattgcagccggcgagcatccagcagccggctttctgctatctccagctgacggcgcaactcgtccaccgcgcgggctgcctggaatgccgcctgccgcaccggcaacaatgcgttccgcgcagccacctctcgcgcttggcgctcttgcatgctccccagccggcgggacactttgcaaggatattccaacccctgagcgtggaaaaactggaacatggcctcgctctccagtcgcgccagcgccaccggctcccacgtgccacgagggcagatcagcaaccgccagccgcgggcgcggccttcgccccccgcagagtggcagctattccagcgcaccgccgggtgcgcgcgctcggcggcggcgatcagcgccaggatgatgtcttgatcgtcctggtcttccacctccacgccatcgacaaacacctggcgcactatttcaacgcgaatgtcgtcgtaattcggctcccggcccgcatcgctggaccagtctcgaaccaactcgcgcagggcttcggtcaactcggcggcgtattgctcagccttagccagggtggtgaaagattgggcggcgtcatcgcccatgtcgtggttggtttggctggcggtgaattggatctggtattgcatggttttctcctgtccccagcaccctggggaggggtaggccgcaccgttgcggccatggcttcactatacgccgttgcatgattaatgcaacagaattccactgtcctttcgtgcaggtgcagctatcccgccatatcttcaagccgtgcctccagctccagcgccgtggtatagccgccgtcgcccagctggtgggtgactttcttcagcacccagccggtggcgtcgatgacgggcttgaacccttgcacctgggcgggcagctccgggaacagctcggggcggccttcggccagggtgatggagaattcggcgacgccgcgttgcagcttctgccaggcggctttcgcgccctgggtggcggtggcctcgctgacgtaaacgtggcgcaaaaccttgatgttttcgctgctgggttcgatgcccttcgcctgaatggcggtcagcttggtgcgcttgctcttgcggcccagcttggtgacggtggcgcggcgttcaaacttggtgtccttgttgacgatgacttcgccctttttcgcgccgcgcgtatcgtgccagtaggcttttaccgcggtgtaggcattgcggtcggcgacgctgaagcggtgattgtcgccggactggcgcaggatcaggcaggcggggaaggggtggccggtgacggtttccgcatcgcccgccttgcaaaacactagccggccggatttgacggtggccaccgcgtcgtattgcttggccaggcgagtcaacaggttggcgtcgctctcgctggtctgatcgatgtgctccaccttttgccgggccagccaggtgggaatggctggcgtcagcccgttcgccttggcgatggccttgacgatggcgcccagggtggtcttgtgccagctcttttcccgcttggtggcgatgccggcgcgcaggtcggtggcgcgggcgcgtagcgtgagggtgtccggcgcgccggtatgctccacctcatcgacaatgtaactgcccttgtccaccagcgccgcgccggtccagccgatggccaggctgatggtgacgccgcgctctgggatgtccagctggccgccgctatcgtccagcacgatgtccagctggtcggcctcgaatccgcggttatcggtaagcgtcaggctcatcagcagcggctccagtttggcggtgatgtcgcgccctgccagcagcagctggcaagccggacgcttgggctgcgacaggcccagggcgttggtggcgctgtcggccaggccgccgacggcatcgcccagctggccggccaggttgtccagctggtccgcgccctgttgcagcatgtcgccggcggcgccggccacgtccgcagcatcgtcaaacaggctcatagcgccagctccagcacgccgcgcgccagcgcgcccaggctatccagcaggctgtcatccacgcgcttcaacgccagcgtgaaatccagcgcgcgggccttgccatcgctgaagaagtcctggcgggtgatgtccagggactccaccacgtagaacccatatatcgcgccggttccctcgatcagcggccaagctttgccctgatcggccatcagcttcagcagcgccagcgaggtatcgccgccggtcaactccggcagcagccggccagacagggaaatggtttcctcgtccgcgcccaggaactggtacgccggccggcggccgacgcggccattcgctggccagcgccaggcgtatttctgcttgaagtcctgatagggcagggtgtccatcatgaaaacgaacaggcccagcgccatcatcggcattttgacgggtccgatgttgagcattagtcgatgtctcccaggtaagagcggcggcgcgcggcctgctggctggctgacgtcgccagcgcttgcgccacctggcgttgcaccagggcggcgagctgctgctcgttcatgcctggcgcggcgtggatgttgatagtgatggccggggctggcgccgccatggccggcgcgcgcgcggacaggggcggccggttgtccagcgagccggccagcgccgggccggcagttagcgcgatgccggcgccggcggcggtcagccgcttggcggtgtcgcgcatgctggccagcggcccggcctggcccttgtcgatgccctgctccaggccggccatggtgtagccgcccagctgggccatgacgcgggacggcgaatggatgtcgagcgcggacttcagggccgaaaccatggtatcgcctatgccgcccagggtatcccgcagcgcggttagccggctcatcacgccgccaatcaggccatcaatcgccatgcggcccagctccgccaggcgcgcgcccatgccgcccaggaatccggtgatggtgtcccaatgcttgatgacgaggccgggcagggtccaattcaggaaccagtccgctatcaccttgccggcgccggtggccttggcgctgatccagtcccaggccacttgtgtggccgactggatcacgtcccaatgcttgatgacgcggccggccggcgtccagttgaggaaccagtccgtaatcacgccggcggcggctacgatgatgcccttcagcttgtcccacagcgctgcggtgattttacagatgtcttcccaatggcggacgatgaagcctaccggcgtccaattcatcaggtagccggtgatccagccgcagacggtggaaaacaccgccttgacgccttcccacagcgcggcgaacttggggccgatccagtcccaatttttccagatcaggtacgccgcggcggcgatggccgttactaccaggccaatggggttcatcaggaagacgcggcccacccacatgaacactttgcccagcatgcccagcccgccgccaagcaaggacagcgcgccgcgcagcagcccaaacacgccgcccagcgaacccatgacgatagacgccttggacatgaccaggcccagcatggcgaacggccccatgaccgcggcggcggccagcgccagcgcgcccagcccggccagcaacaggccggtgatggcgatggttttcatgatggcactagccagctcggggttttccttggcccaggcgcccagcttttccgacagggtgccgatccattccgccgccgctttcatctccgggccgatggcttcgccaaagcggaccatggcatttgtgaaggtgccggatgccgcgtcccataggtttttcagggtgccaagctgctggttgacgcgcgcttgcagactggcttgtgccgccaggttttgcaccacgtcctgatagccgtccttgcctttttcgatgatcttggacaggacttcgctggtttccttatcggttccgaaaatatcctgcaacacggctatgcggttgacggtattcagttttttcaactggctgagcttggccatcatcttgtccaggccgccgaactcccccttgccattggtaaagtccaggtccagcgcaatgccctttttcttgcgcaattctttctgaacttttttgatcttgtccacgctgaggctggcggcgatgactttgcgaatggcgttgccggctgactctccgcgcatgcccgcctgatccatcatcacgacgaacggggcgaaagctttcgcccccgccagccctttgaccttgaccatgtccatggctgcgcccaagcccttgtaggcttccagcatgttgtccggatccacgccggcgtaaaagccgcgttggatcatgtccaccaggcccatcatgtctttttcgctggtgcgggtggcatcttgcagcttggcggtgaattccgcagccgcctccggtgtcatcttgagctgtacgcccaggtaggccgccgcttctcccaagccgcccaggacggcctgagcgctcatgccctggcgttgcagcatcgtcatcatgttctggaaatcggcggtggtgccgggtaggcggtcgcccagcttttgagccaggttgttgatttgctcaaactccggcggaaccacgccaccggcacgcatcatcgcgcctttcagctgcgtagccgcatcttctgcttccgcataggccatgactggcaaagacatcgcgccgccaatcgccgcgccaccggcagcggctttcacgccagcgccggccaccttgtcgcggatggcgagatgccggccatagcgttgctgcgcatcgttgagctgacgctgtcgcttggccacggcgtccagcttggcctgacgcgccccaagcgcgcggttggtttcctgaatacgggcggcgagggcggtttccgtggcggacagttggcgggtgtcgataccttccttttgcagcgcgccagaggcggcacgcgcggcatccaggcgcttgcggtgggcgagggtgagtttgtcgacggcgcgctcggcggcggcgtattcgcgggacagcttgaggctggcgccgccggcctgctccatctggcggcggacatcctccagccgctgcttggcgccttgcagcgcctggccggtgtccttgctttccttggtgagtttgcggaaggcgtcgatgctgttttgcgtggcttgaagctgcttgagttggtcgcggttttccttgacggcgcgcgccagctctttgttgccagccatggcttgcttgagcggccgtgtcagcttgtccacggccgccaggatgacttccagtttcagctggctattcattgtcggcggctcctgatcttaggcgggccgcctcgcgccagctggccagctcagccagcggcatggcgccataggctgagggcggccaatgaaaaatggtggcgatatcggcgatggcgtcgtctacgctgccggggaggggctggcttgcagctccgatttcttcaacaaaaaaccggccaccacggtggcgcattgcagcaggtcggccgggtccagccgcttggcctcttcttccgtcagcgccggcatcgacaggcgcggcagcagcttgatggcggcgtccacgtccatctgcagcacgtcggccagcttgaggccgcgcagctcgccggcgccagggcggcgcagctcaatggtgtcgatcagggtttcgccgcgttggatgggggcgtccagcttgatggtgttttcgttcatggtgcggggttcctatgcgtgagggcagcccgccgacggcgggcatgttgggttataagccgacgttggcgcggtgctgggccatgcggtcttggccggccaccttgaacacgtcgttgacgatgtcgatttcaatcagctctttgccgtccatgatccatttcaggtaggtcaggtcggttttcactttgaactcgccgttctcgccggccttggcgtcgccggggtccagatcgttatggcggccggcggcgacgatttcgacggcgtggctttccccggtggcttcgttggcatagctgcccatccagcgcagcttggcggcgtcgtgtttatccgcgccgaaggtggcgatgatttcgggaatggggccgttgtaggtgtgctccagctccagcttctccactcccctcagcagcgccaccgggccaatcatgccggcccccgagtagtcctcggttttcatcttgagcgcgggcagcttgaccgacaggcattcggcaatgaaggacatgccgtcgttgaacaggttgaacttgcgcagggtgcgcggcagtgcggccatgatttctcctttacgccgccgccttggcggcaaagtccatcaggtattcgtcggtgatttcctgctggaattgcaggttttccagcggcggaaccggggtgtatttgtagctaatgcgcagctggccatccttgagggtgtccttgctgttgaggtcggccggcagccaggcgctgaagcccagcagatagccgcgcgtcaccaaatcccggcccttggcgttgatgccgtccaggatgtcgcggaccagtaccggcgtcatcggctggtccatcgcccacatatgcgactcggcgatggtgtcggccagcacctgggcggtgcgggtgtaggactcgaacgcgaacagcgggtcggcgctgcacgtgcggttgccccaaaagcggaagccgtcgcggcggatcagcgtggtgatggctttttcgttgaggtagccggcgtcggtggcaggctcttgcaaatcccaatacacgtcctggctgatgccggtgacgccttgcaccagggcattggacaaggtcttgtgccagccgatggactcatccagcgcggcgcgcaggccggcggcgcaggccgtcaccgggacgatggcatcggccgcggcggcgctgtcgaaggcgaggaactgcggccagatcagcatcagctcgcgctggccgaagttggcgcggtaggcagcgacgtcttccttggtcttgcagccccaggcgtagacataagcgaaggcgcgcagcttggcggcgatggcggccatttccgtggcgacgggcagcgagtccaggccgggcgctaccagaatgcgcgggcgaacggctacccgctgctgagcggtgagcaaggcgcgcaggccggtgtattggccggccggggtcgtggtgccgatggtcagcgccgattgctcggcctcgtccttgccggttttgacgcgcaccaccacaaccagcggccgggcgttggcgtcgatggcggtcaacgcgcggcgcagcgttcctttgctgccggccttgccgatggcggccttcaggtcggtcagcaagacggcggtgtccaacgggaaggcgtcggcgtcggcatcgtccgccgtgcagaccatgccgatgacggcggtggagatggtgcgaatggtccgggtgccggcggtggcttcgacaacccgcacgccgtggtggaaatctttcatagctcggtctccgggtgaggttccgagcatgttgccggctatattctgttaagtcgtgttgtgcttgttgtatgagcgcatggcacaacctagcatagaatttgaccgtatttttacgtatgactttatgccctttcccgtgtccgacctgatccagcgctttctggagacggcggacgctcgggatatgctcacgttgttggatggcatggcgaaaatagcgaaagaggatgctccgatgcacttacgggctggcctggcggaggatttgcgccagctactggctgacgcgtctttgcgccagcagatgcaggcccggcaattaggacagttaaccgattccgaagtatccgtagttttacttatcgccgccggccagagttaccgcgatgccgcgctagcattgggcatcacggaacgcaccatccgcgcgcacgttgaaaattcctttagaaaacttgggcttaagtccgaaggcagcaagcggctggactctcgcttgctcgttgcacatatttttttgcctgatcttatgcaacgcattggcttaaacgccaatatccaggcgagcgccattccataaaatagcggcatagcatttcatgctgagaaatgcagaaaaaaaggaaacaaaatgcacagccgcgacgacgcacacatattgaatcccctgattggccaagacccacgcgaaacgctggaaaacctctgcgtctgtctggcgcacctgggccagacgctggccagccaccacgaagacccgtccatccatttcattgccaccagcgccgcggcggcgttgaggtttgaggccgggcaaatcgccgcctgaaggtagcccccatgaaagaacaagccccgcagacgcggggctttttcattgcgcggccggcgccggcggccaggttatcgtcgccgggtagtcaggctgcagcggcactcgggacaactccacccgatagcgtcgccaggctgccagccgctcggactcggccggcgttgctatggccaggtcagcagcatcttgtagcggcacgatggcggcgtccgcctggccgcgccgggcggcgatgtccgattccgccgcggcgcgttgtgcagccaacgcggcagcgtggtcaacgcgccagctcgcgccatcccacacgccaaagggcggcggcgccaactcggtcgcgcccagcgcctgcggtgtgtcgcccagttgcgcggcaatcggctgcgccgtggcggtatcccacagcggcaccgcgcgccagtccggcagcagctgccagccgccgcccaggatgcaatgggcgggaatgcggccatcgtcggtacgccacgccgcagcctgacgtgaggcggccggcggcggcgcatccgcagcagcccaggcagggacaagatagacctcctcctccagctccagcggcgagcgttgcgcagtcgtttgcccgacatattcgccagtatcggcgctatagcaatacacgatttttttatcagccatggggttctcctcagattttgatgcaggccaggagcgcgatatttcgggggcgggactcactgccgccggagccatacgtggcataacgaagctgccggcccgtgccgaattcggttaaaaattcattggatgtgtgcctggcgccggcatccaagccggtgccgccgttgtcggtgcgcacggtatccccacccgttgtcgagccgggtgtcgggatggcgtgatcgtgccagaggttttgagacgcctggccggacccgaacacacgggaggcatcgacgttgcgcccggcatcccaaccgcggacgaactcccctcgcaggtcagggacgccaaacgtagtccggccgtcgccggctccgaaccggtcaccaatggcagcaaacaacgcggcataggcagtccgcgagacatcctgagcgccggcgcagatgagccagccaggcggcggcgtatcgcgggcgaaataggcgatttgaccaggcggcgtcgcggcggcaatgccatcctgaatggcggccgcatctgccaggcgccgccaggggttccatcgcccctgatagcggcagcggtgccaaaatcccccatcggcaaacgcctgataggtgtgatagaccatctcgccggccgccctcacggtcagttggccggcctgcgggcagggccagttcttgcccttgctggcattgtcgttggcggggttgtggtagatgccgctggcgattaaggtgtccagatccaccggcgccgcgatatccgcctgcaacggcagcgcgtcggtgatgccatagcctgccagtgtagtggccttgtcggctttgtttgcaacttggcccgcctgatcgcttaccaccgatgccgccgcaaatttctcatgtagccatccgtactttttggagtaaatctccccgctggcgcctaccgccagggcttcgatattgtcgattttcagcatgagcttggacgatccgcttcccggtcggctgctttgtgcggcaaacaaccccgtatcgccatcttcgtcaaacgcaaaaccagcggtcgcagtgtcgccgcccaaatcggcggggtctcccttattggctcggaatgccgccccccatacgcgctttgccgggtcgcgccaggccgtatctgtaatgccatagccctccattgttgatggccggccggtgatcttgccccagtccagcgccggcacgtcggctgccgccatctgccggccggcgatgacgcggcccttggcatcgaccgtcaccatgccatagctgccggcgccgacgccggtattggccagcgtcagcgcgccgctggcattgccgctgccgtcgaacgtcacggaccatgcgccatcgcccgtcatggccaagttgcgcggcgaggccaggcggtcggcgcgctcggcgcttttggctgccagcgcgccggataccaggtcgtcgattcgtttcttgagaaaccccgtccgctctaccaactgctcagcctggcggttcgagatgccacccgcgccggccctgacgcggtcggtcaattccagttggtaaacgggggggaacttcggctcggccggttctttcaggtctgccatttatgccactccgaatgtgtagccgccatcgtaggcggccatgtcgttgtaaatcagttccgcgccgccgaagtccagcccccacaacaggcagcgggccggggcgatgtcggccagcagcgcgcgggcggcggcggcctgctcgacgctcagcagcttgtcgatgcggacgcggtattccgcccagccgtccgggtcgccgtagctggcgaaaccgtcgtaggccaccgtgttgtcgtagcggtagccgcctgtcccttcatcaatctgcacttcgcccaggcccaggtcgcggaacacctggcgcacggcggaaagcgttcccttgcggcggtgcacatcgaccgacgacgccaccagcgcgcggcgttcctcctctgtccgggccgcatcgaattgttcgacgctgcgctcccaggccagccacggcagcagcgccggcgggcagcgcgcgctgtcggccaggccgcgcaatgcggtcgtgttcaggtccagcgccagcatgtcggccagcgcggcttccagcggcgtgcgattggggggcagcagctggcggctcatgcgggcgtcaccatgatggatgcgcagtcgggatagcggccgacctggcccagcacatcggcggccgggctgacgatggcgacgcgctccacgccgtccacatgcagcgcggcgtctatcgcagagcgcggcacgccgccaccaatgcggcggcgcgcggccagcatcttggccaggcgctgcgcggcgccggccgcgccgccgctgagcgcttcgccgcctggctggtaggtgatgtcggcgcggatgtcgaatgccagcggcgtggcggcggccgtggtgacggtgtcgcacagcgggcggatggtttccgcgttgagcgcggcggccacggtatccagcagcgcctggctggccatgccgtcgcggcccagcagccagacccgcacctggcccggcgccgggctgtcgatatcgacatcggccacgtcggccgacgcgctcagcgcgtgaaagcggtacgcgccgcgcgggccgccggcggccagtccttccagcgccatctgggcgcgatagcgcaggcgcgcatccgtttcccattccgccgaggtcggcggcgtggtggtggggtctgccgggcgcaccagcaagcgccgcacgccgtagtcggcggcgcggtggtccagatcggatttctccgcgtaggcgagcatggacgccttggcggcgtcgttgatgcgctggcgcgcggtcaactcgatgtaggcggccagctggctcagcatcgtcaccggttcgctatccagttgcagcgccgcggcgatggcggcgcgcatgtctgccggcacggccgccagcagcttggccttcttttgctcgaacagggtttcatagtccagcggctcgatgacggccggcggcggcagcgcggcaaggtcaatcgtcatggcgttagctcctgatagggatgtcataagccagcggcttgccgctgtcgcggcggcggccggctatgtggatggtcagcgcgccggcggcatcgccctggcccaccatcagtcggatggcggacagctcgatgcgcggctcccaggcggccaccgccatgacgctggccgccatggcctgcatgcgggttcggccgttgagcggctggtccatcagctccggcagcagcgagccaaattcgcggcgctggatgcgcgagccgcgcggcgtggtcaggatgcgggcaatggattggcggatgtggtcggcgtcgctgatggcgtggccggtttgcgggttcatgccggtatagctgctcattggggctttcctacattgccgccgtgcgggtcggggtgggtgtggctgtgcagtgtcacgccgttggacgacaacgcgccgccgctatgggtgatggtgccgctgatggtggtggacgcgccgccggcgccgcccgatcccgccatgccggcgaggtagctgaacaggcccgctatggtggccttcgccttggccagcacatcgcccagcacgatcagccggccgttgatggtgacgttgccggtaaacagcgactcgggacaatccacggtgacgcgctgcgccgcctgcacctgggcagtttgaacgccggtgacggacagggcgccggtggcatggttgtagaggatgcgggcgccgtccgggtagacgcgcagatgctcgtccgggctgctgctgggcgcgtcgaactggtcggaatagatggccagcagcgcgaagccgccggccgggtcgccgctggggcagagcagcacaacctgttcgcccacggtgggcgggttccactcccgcgtttcgccggcgcggccgacgctccagggcagccagttgctggccagctcgccgcttttgacgcggacgcggcgggcgtcgtggtccacttcggcgatggtgccgtagcgaatcagcgattcaatgcgtcgaatgaggtctgcgatatcgtccatgccggccagtttgcacaggccggcgtggggtgtcgcgcggtgggtgttgtgccgcttcgccgcacaacacccgctatgccgcaagcggctggccatcctccaatgccagttgcgcttgatggtagatatccggttccagctcgcagccggtggcggataggccaagattgcgcgcggccaccagcgtggcgccgccgccggcgaacgggtctagcacatggccgccattgccggccagtttgcatagttcctccatcacggccaccggcttggctgtgatgtggtaggtcttggtcggcttgcgtccttgaaaaacgccgggtaggtagatatccgccttgcgcatcttgcccttactggcccacacgatgaattcagcctgctgtttcatcccgccttggcgcggtctggcgccaccgttggttttatcccaggccgccacgccttgccagatgaagccggccatctgcattgcatcagtcagggtgggcagctgtcgccaatcgatgaagacggcgatcaggtggccatccttcagcacgcggtgacattcggtcagccactccacgcaccatctgcaccagctgcgctggtctttgttgtcgtgggcgaattggtgcgtggctcgctgaacatcattgcccaggtatttggtggccggcggttgctgtcgcgtgcctacatgcaggccaccagaggaatacggagggtcggtcaggatcagttcaaagtgattggcggggagggtcgggagaaaacgcagacaatcggcgttgtgcagctggatggacatgaagttccttgtgttgcgggtgttacgggtatggcggtgttacttggcgaggtgatccaacaccttggaatggatcagctcgaaatcaggttggctcagccccagcagttcgcgtgccgggtattgcgcttcgcgggtggtatggcggctgatgcggtcgcgtaggccgtattgatggacgcgggcgatgcgttccacctggcgcagaaagccgacctccacgccgccgacgctggcctcgatcttgagccagcgcgcgccgcgcagcttggtgaacatctggctgcggatacggcccttttgctcgcggtattgcggccggcgcggcgcgaagccgctgccgtccgggttctgctgggcggcgatgcgcttttgctggctctgccgcagcgcgtggccgatttcgcgggccaggctgcggcgggcgccggtgtccaactggtggatcagcgcgcccagctcggcgtccaggcgggccaggctcatggctgcgcctcggcgacaatgaccagccggccggccattgcgtcgccttcccacggcgcgggcggctcgccatagtgggtggcggtgatgttgccatcctcgccgacttccacgcgcacgccttcggacagttgcagggtgaactgcacatccacggtggtggcgctgatccattccaccgcaaagcggaaaccccgctccagcgcctccgggttttgcatgagcggcggctcgttctgctcgatccaggcccgcagcgggatgatgagctggtccaggtggccggcaaagtcgatgacggtgattttcagcttgtagcgatagccgaagttcagccggccaggcgcggtgacgatgccgccatcctccaccagcatgatgaggcggtcggggttgtcacgcagctcgggcaaagcggcctcgatggcgcggcgcaggtcagcgggcttgttcatgatcttcctggcactgcacgcagcgggtgcagccggcgacgatgcgctggcgcgcttcgggtatcggctcggcgcaatcttcgcagtggctcaggctggcgccgtgggcgaggttggcgaattggcgggcgagggcttcatcgcgctggcgttgctccagcgcctgggcgcggtcgtaaaagtcagtcatggctgttggcattggatgatgtggtcgatctgcgcggcgcaatcctcaagcgccgcccggtgttgttgccagctgttggccagctgttggttggtcgtcggcgccagcgccggcagcgcgcaagccgtcaccgtcgggcagcgctggatcagcagcgggcgcggcggcgcggccggtggtgtcgaacaggcgggcaacagggccagggatagcagcgctaccccaggcgacagcgtcaggcgtggcatggatggcggcctccagtttcgccgcggcggcggcgtgttgacgggatagggcggacagctggccggccagctcgcggccggcggcgatctgcagcttgatgtcgatatcctgggcggccagctgctcgccctgggcgcggttgcgttcggccagcgtggcggcgtcgcgttgggcggccacgaggtcggccgcctggcgctgaagcaaggcgtgctgctgccagagggcgaagccggccagcagcgtggcggcgatcaggacgacggccaggacgcggcgggcaaaagtcagcagggcgtcggcgatcatgcggccagcctttccgcccgcgcgtaggcggcggcgagcttggcgtcatagaggttttcgcggtaggccgggccgttgtagagccgggccacatccgcccaacgcttggcttgcagggctttcaacaatgcaggctcagccaggatgaagcgcacgaaggcgtcgagctgggccggctcgccggattccatcgccaagcgccattcggcggcgctggcatagcccagccgctgccagtgatagcccatgagctggaatgcgccccagctgcaagactcgatggccagctgttcgccgcccatgatggccaagctggcgaagcgcgcccattcggccgcgccgccggcgtagccgccgcgggccttgttgcagacggccgggtattgcgcggccaggctgtcggcctgcttgccggcgcgctgataggcgacgtggcgctccagcaggatgacggggcggccatccgacagaaaaccagagccgcgcgactccaccgcattgatggctttgacggccgccacctctacgcccagccgctcggcggcttcctgaaggtcggcttcgcccagctgacgacgcgggccgacttggcccgccagcgcggccagggttttgccgccggcgatgccatccaccaccaggccggcgcggcgctggaacgaggcgacggcggcttcggttgcgtcgccataccagccatcgacggccagcttggcgcccacggcgaccagccgctgctgcagcgcttgcacttccaggccgtgcgcgcctttcttcatcagatccatctggctttcctcagcaggatggccagccgcgactggcgcgggccggcgttgcggtacagctccaccacgttgccgcgctgggcgatcagcgccagcaatagcgccaggttgatgaacagctgcggcagctcggccagctccgggcggccgaacaggcgcagcaccgccaccgcgccggcggcgacggtgagcaggtaagccagcaggctggcccacggccggtgctggctggggccgcgctgaaaggccagcagcaccaggacgaggagggccgcgacggcggcatgtgcgaacgcgatcatttgccgccccccttcaggttgcgcagggccgcggcggggtcgtccgcgcttttaatcagccattgcagcaatttgacggcgagggcggcggccagcatcgcgcagacgccggggctgatatcggcgatcagccagcgcgccagcacgccggccacgctgacggcagccaagcagccggcgatgaaggacgccacgaaaaatccggcctttttggccaggctcaggctgtccgaactcagcacgaacacggcagcgccggcgaaagcgcccagcacgacagcggcgtcaatgcctggcgtcagggccaggccggcgatggtggccagcgtcgcgctggtggcggtactgcttacaggttctgccatggtcagtcccataggttgatgagggttttggctgtcgcgggagccgccgcgggcaggtccggcaactgaaccagcgtgccgctgggcaagacgacgcccaggtcggccaggccggggttgtgttgcagcagccgctccaccatgccgcgggtttggccgtagacgcgccaagcgatggcgtccacggtgtcgccctgaatggcgcgaacggcgcgcatcagatcaactccaccgtgacgcggccggcgcccaggatggcgcggatggcggcgcgggcgtcggcgcgcagctggtcggcggtgtcgtccagatcgtcggcgcgctggcggccggcgccggtggcgtcaaaactccggtagcgctcggccaggtcggccgcggcggtggcgtagatggcccggcgccagcgctgcaccaggatggactcgccgtcgatctgctccgcctcgatgtcggccagccgctgcgcgccgctggccacgcgccagccgaacagctcgccattgacggcggcgacggcctccaccagcgcgtggcgcaggcggacggcggtgacggtgccgtcatagcgcatcgcggcgcggaaatggccaggctcgacgtccggccagaagcggctggtctgaatggctgggccatcacccggcgccggggcgttggtgggcgaggcgttgacggtgttgacgctgttgatctgcatggcggctttcctgatggggtgacggtggagggggcttcggccgttggcttgcgcctggcgtccaccccctgccgtcagtcgcgcggggtcgctcggttacgcctggccgctggtgggcggcggggcgctgttcttgatggtgcgttcgatgcgctcgatgtcctttttgacgccgacggcgccatgcagctgctgggcgcggcgcagatgctccagcgcggcggccggctccgcttctgccatggccaggccggtttccttgagcagcttggcgcgcacggggtccggcatatcgtgcttgtcggtcagctcggaggtgtaggtcagcgtctgaagctcgaacggctgcttgccgtcgcgggcgcgcttggcggcgtcggcgatttcctcggccacggccgtggccgtggtgcggctgaactggtccggcagcggcaggccgtgggggagcgcgtattcggcgatatccagcgccccgttgtagtcgccggcgtcgatgcgccacatcaggaccgtcatcagcacgtcgtcgggctggcccttgccgccttgcagcgcaccgtccacccaaggggcgtaatcgggcaggacttcgcgctttaccgccgccttgccttccatggactggacttgcttcaagcgccgcttgtcctcggccagcttgaccagcatcagctcgtaggcggtgcagttgatggggccgtcttccacggccaaggccgaagccttggccgcgctggcccgctggaagtgggcgcgggcgtagctcatgccgcgttcaccatctcgatgttttccaccaggcagccggcctcgtagcgctccaccacgtaggcttcgttgttgctctcgtagttggccacttggttgtaatccggctcttcgcgcaggtgacggcggcggctgccgctctggtagtagatggacagattggacagcggggtaatcagcatcgcgccggccgggaagtagggcacggaaacaggcggcaggccgccaacgcgcttctggctgatgacgacatcggccgccatctgttcgctgggcttgttgtcctgattgacgatggggaagtacttgtcatgcagcaggtcgcggcccaggaccaccaccaagtcgggattgcccgccatggccgggtcaatcaaacccgctacggcatccatcaccagcgcgtcgaggttggcgtagtcgccgcccttttcctttgccccgatcatgaccttgcccgaacccttcttcacttccgccatcacgcgctccggcgcatgttcgcggtattgctgcagccagcccttgttgacgtcttgcagcagcggaaacttctcgcggttggtctgttccgccacactgacgccgttgaagccgatcatcatgcggtccagcgcctgctgcttgacgatgacgtcgcgcagcttggtctggaagtccgggaacttggcccaggcgtccagctggacgaagggaatggcggtgtcgaactcagtgaattcgcagcggtatttatggctgttcaggtcgccaaggttgcgcgggcggcgcgggttggtcggcgtcactttggtgcggccggcaacggtgccgaagatgcccaggcccagcttttcgccctccagctcatccacgccgttgatgttgatgcgggacaggaattcgctcgattcctgaatccgggtttccagcttctgctggatggtcggctggacgctgaaggacttttcgacggcggcggcgctgacgccgtttagcttggcgatctgctccagcagctgggtgaacacgttgcgggtatcggttttcatgcggtatggctccggtaatgggggatggcgggtcagcagtcggtgacgacttcggcggcggcgccggtggcggcgctgcggggggcggtggcggattcgctgctcagtttggccaccagggcgtcatggtcggttttgagctggccgtactgctcgcccagctttttgaactcggccgcggtcggcaggccgctgaattgctccagcacgccggcctggctttcggcgatggtttgcacggcggcggacagctcggcggtgtcggcggtttggcggctggagaatttgcccagcaagcccttgatcttgtcgctgaagccggccagcgcgccggcgttgtcgtcttccagctccagggtgaattcgatggcttcggaaaataggttgtccgggtcaaactttcgctttgccagcgggttgctcttggctgttgcgctgaacttcagcatgtcgcagcccaggctggcgggatcgtcggtgacggccaggccgaccagataggcttcgccggtgtcggcaaacttcgggttgatctcgatggatgagtaaactttttggcgatcgtcgtttgtcattttgacaagatcgtcagtcggatcgataacagcgaacagcgccagcttgtcgtcttccactttttccgcgctcagcgccaacacatcgccatagcgcttgaatggactgtccggcgtatatcccttgatgtgttccatattgacccgtgcgccgtatttcttcgggtcgtaattttttgccatctgctcgatccagctgcgctcgatgttgcggccgtcggtggtggcgccttcggtggcgacacggaatttctttgccttgcttgccatggtttgcggtcctcggtcgggtgtctgtcgtggcgatgcgcccataatcccggccgcgtggggcggggtcgagcggtggctgttgtgtggcgatcaggcacaaccggcaggcgaagaattgcgccagacaagccggcagactgccggcatggatacccaaacccttatttctgaactcgatctagacccgcgccggctggcccgcgccctctattggcagggctggcgcatcgcgcgcattgccgaacatgtcggcgcgcggccggcgacggtgcatagctggaagcggcgcgacgcctgggacgattccgacccggccgaccgcatcgcgtccaccatcgaaacgcggatgcagcagctgattctgaagaaggacaaggaggggaaggacttcaaggaaatcgacttgctcggccgccaggtggaacgcctggcgcgggtgggcaagtacagccagaccggcaaagagtcggacctgaacccgaacatcgccaaccgcaacgccaagcccaagcgccagccggaacgcaacccgattaccgatgagcacaaggcgcagctggtggcggccttcctcgatggcatgttcgactaccagaagcactggtacagggcagggcagcaagagcgcatccgcgacatcctgaaaagccgccagatcggcgccacctactatttcgcgcatgaggcgctgattaccgcgctggagaccgggcgcaatcagatcttcctgtccgcttccaaggcccaggctttccagttccggtcctacatctgcgatttcgtgaaggatgtcaccggggtggagctgaagggcgaagtcatcaagctgcccaacggcgcggagctgtcattcctggggacgaacagccgcaccgcccagggccgccacggcgacttgtatgtggatgaatacttctggattccgcgctttctggagctgcgcaagctggccagcggtatggccagccagaagatgtaccgccagacctatttctccacgccatccgccatgtcccatgagggttacaaggtgtggaccggcgagcatttcaaccgcggccggcccaaggcggaacacatcaagctcgacgtgtcgcaccaggcattggccggcggcgtgcgcgggccggatggccgctggcgccagatcgtcaccatcatggacgcgctggccggcggctgcgatcggttcgatctggatcagctgcggccggagtacagcccggaagagttcttgcagctgttcatgtgccagttcatcgacgacggcgccagcgtgttttccttcgccgcgttgcagcgggcgatggtggatgcctgggaggtgtgggacgacttcaagccgttcgccgcgcggccgttcggccatcgcccggtttggcttggctatgaccccagccacaccggcgacagtgcggcgctggtggtgctggcgccgccggccgtaccgggcggcaaattccgcatcttggagcgggcgcagttcaaaggcatggattttgccaagcaggccgacttcatccgccagcagacccagcgctacaacgtcgaatacatcggcatcgacacgtccggcctggggacgggcgtctatcagctggtgaagcagttccggccggacgcggtggcaatcagctacagcgtcgaggtgaaaacccgtctggtgcttaaagccttggacgtgatcaatagcggccgccttgagtacgacgccagccacaacgacatcgccgcggccttcctgtcgatcaagaaaaccagcacccccagcgggcgcggcgtcaccttcgccgccggccgctccgaagaaaccagccacgccgacctggcgtgggccaccatgcacgccctggcgcacgagccgctagagggcgcgacttccaccaataccagcttcatggagattttttgatgggcaaacctcgccgcagccacaaccattcccaaaccccggccgcgccggcggcgccatcggctccggccagcacgccgctggcgttttccttcggcgagccagtgccggtgctggaccggcgcgaaatcatggacctgttgcagtgcgtggacaatggccgctggtatgagccgccggtcagctgggacggcctggcgcgcagcctgcgcgccaacgtccatcacgccagtgccttgatggtgaagcgcaatgtgctggtcagcaccttcaagccgcatcggctgctgagccggtcggcgttttcggcctggctgatggattatctggtcttcggcaatgcctatttgcaggccatcaccaatcggctgggcggcgtgatggagctgaagccggcgcgcgccaagtatgtgcgccgcgccaaagacctggccggcttctggtgggtgccgggtttcgaccaggagcagcaattggccggccaggtgctgcatctgatggacgccgacatcaatcaggaggtgtacggcctgccggaatacctggccgcgctgcaatcggcctggctcaacgagtcggctacgctgttccgccgcaagtactacctgaacggctcgcacgccggcttcatcctgtacatgacggacccggccaacaatgagcaggacatcgacaacctgcgcaaggcgctgcgcgacagcaaggggccaggcaacttcaaaaacctgttcatgtacgcgcccaacggcaagaaggatggcttgcagctgctgccgatcagcgaggtgacggccaaggacgagtttctgaacatcaagaacgtgacgcgcgacgacgtgctggccgcgcaccgggtgccgccgcagctcttgggcgtgatccccggcaacgccggcggcttcggcgacgcgcccaaggcggctggcgtgttctacgaaaacgaaatcaagccgctgatgatgcgcttgcaggaggtcaacgagtgggcgaagctgacgcttggactcggagaggacattatccagtttggcgagtatgcgctggctgccgcggcggcggcctgactcgtcgcaagcctgaaggacaaagccccgcggatgcggggcttttgctttgcctacctcagcgaaaggaaatcccgcccggagtgccggcggcggcggcatccagagagtggcgcagcgcggtgtctaggcacgggatttcgcggagtcgcgtttttggcgatatacccacggcgcggaatctctcgatggcaatctccagctcttgcaccacgattagttggccgccgacatattggtcgcggccttcgtgtggcggcataaggtcgcgggtttggtcgatgaacacctcgcggaaccgccgcgtgatctgccgtgcctccagcaatgtgggctgccctgatttgagcaggcgtattgccaagtccagctcatcagccagtagctctatggtgtacggcgtggattccatgtggcttcccattttgaatttgtacgaattcaaattagaccacgctcgacagaatatcaatactagccagaaccattgcggcggcatgaatgacaccgcgccaggtcggccagcccccagcgcgcgccatcgaagccccgcctcgcccccgcgcttcatgtgtgggaaatcatgcatgcgcatgaacggcccgcaaacgccccaggcgcggcgctctcgcccgctggtggggtgccgggcctcatgcgctttcatgcgcgctatgcatgcagcagcggcaacggcgactgtctcgaatagggaacacaattaaggcggggtggttttgtgagtggttttgtttttacttgattgtttttaaacaaaatggcacggattgcaaatccgtctacgccggttcgattccgacccccgcctccaaattcaagcccgtaaatctcaggatttacgggcttttgttatttatttcacagaatcgtagcaatctcacaattctcctcctcgccacatttggctttgccgtctggcggccgcttatcctgttggaaggatcacgctttgcgcggattccaccagcaagggcagtcgggcctggccggtgtcgccgccgggcggaatcaggaagcaatccaggccgtcccggctgccgttttcttctatctggcattccaatacattgcttacgtatagcagcacggtcttttgcagcggctgcagttcttcggatagttgcagcagaatgaaaggatggtagcagtcgtccgcctgggccttggcctgcaagccggctttgagaagcaggccggcgatatggtcggctcgattgatgagcttctgctgggcgtatatcgcgtccagctggctgcggtattgatcggcggcttttcttaccagttcggcgtaaaggctcatcgcaatctcccatggcaatgaagaagcgggcgccgaatggctgtttggcaggcgctttagctaggtgtagctggaaaagcggacgcgatggacggtccgcttggccagttttcccggcatggcgggagacggccggcgtcacagccgggcggcggcctggatgatggcggcttcgcgctggtcgcgcagcgcgtccagcctggtcctggccgctgcgagtatggctgggctggcatcctcgggacggccggcggcgaacggcggcgcgggcgcgtattccagcgccagttgcaccgtctgcgcgtagtcggcgccggcgatttcggccatcagggtcagcgccatgtcgatgccggcagttacgccgccgccgctgatgatatcgccgtccaccaccacgcgcgccggatcgggctgggcgccgaacgcggccaacgagtcgcgccaggcccaatggcatgctgcccgcttgcctttgagcaagcctgccgctcccagcagcagcgagccggtgcaaaccgaagcggtgtagcgggccgatgcggacaggcggcgcaattgcgcgagaaagtcctggtcctccagcgcggcaatggtgcccaggccgcctggcacgcatagcaggtcgcagccggcgatgtcttgcagccgggcaagctcggcgaaggtgatgccgctgtcggtgcggatattgcctccctgcgcagaggcgagcacgcagcgggcgccgggcagctgggccagcacttcgtgcgggccggtgaagtcgagctgggtgacgcgtggatagagcgcgaaaacgatggtgaaggatggctgcatggcggttctccctgggtttgaccttgccatgctcacctgcttatgatttggcgtaaatgacatcattccaccttttcatgccatggcccatcgcattgcggtattgatcttccccggtttccagctgttggacgctagcgggccgaccgcggttttcgaagcggccgggcgttaccgctgcgatgcttaccgggtgcgggcggtggcgcggcaagccggcctggtgcgcagttcctccgggctgacgctgcaggccgaggcatgcgatgccgtcagcttgccggataccttgctggtggcaggaggagaaggggtggcggcggcatgccgctgcccgcaaacgctagcctggatccagcgttgcgaggcggcgggctgccgagtggccagcgtatgcaccggggcctttttgctggcagaggccggcttgctggccggacggcgcgcgactacccattgggcgcacgcagccgatttcgcccgcctatacccggacacgatgttggaaaccgaccggctgttcatccgcgaaggccagatctggacggcggcgggggtgacggcgggcatagacctggctttggctttagtggccgatgatctgggggcggaggtcgcgcgccagagcgcgcagcgcctggtggtgtattgccagcggcctggcgggcagtcgcaattttcctccttgctggagatgcagcagccgggcgggcgttttgccggattgctagaccatgtgcggcgcaatctcggttccgcctggacggtggcggagttggccgagcgcagctgccttagtccgcgccatttttcgcgcttgtttctggaggaggtgggcgtgccgccggccaaggcggtggagcgcttgcgggtggaggccgcgcgcggcgcgctggaaagcggtgaggcttccttgcagcgcctggcgcggcaatgcggcttcggtgaggtggagcggatgcggcgcagctttctgaggatattgggcgcgccgccatccgcgctgaaacggtaggcggttggcctgcctggcgcggagtgcaagtgcttattgtttgacaatgatggttttgattgtggcgcggcgtgatggaaatgaacatgaaggattttcagcgtgccggcctcggtaagatatggaattccatgcgatttacccgtttttcgtcgccggcatgccgatcgagggaccgaaggccccgcagatgtcgagcatgctgaccagcatgtgaaatggcgggtgaggattgggtttttatttgaataacatcgcgcaatatcttttgcgatcaagtaaatagtgttttattgataaaacatcaagatggacgaataaagtcgatgcgcattttcattctcatggcatcgcaatattatttcctcttaatacagtgattttatgttttcgacatccgttgccgggaagctcgccagcctggggcgtcgttgacagcgttttgctttgtcgataaagtgctggactttctcgcagtggccgaagctttaaaatcaagctgttgccgctgaacgagaagccgctgccagcggcgcggctcgtgaaatccctcaggattggcgatgcgccctggcaatacgcgaatccgctgatttttcatggatttgcattatttaaaatgcattgtcagcatgggccctctgggctacaatcgcctgctctgttggccccggtggtgaaattggtagacacaagggacttaaaatccctcggcttaggctgtgccggttcgaccccggcccggggcaccatcaaatggcggagcgcgtggcttttcctgcgcgcatggcggatggcggcgtgaatctcgttgtattaaaatgacattgcacgcgacgcctgtcgtctaactggacaagtggccggttgcatcacgcctcttgattgggcagcatttgctgtctttgcattaatggatctagatagaagttcatgaagccaaatactgaaacggcactcggtgctgctctcaagtctgctgttcaaagcctgtccaagaaaaagcagaccgagatgatcgcggatcacatctacggcaagttcgacgtgtttcgccagttccggccgctggctctgggcatccacgagagcctgatcgcagccttgtcgcagttcgagccggcgctgatttcccgcgtcgtcgccaatcactgccgcaagccgcgctacctgaaatcgctggcccgcggcggcaagcgcttcgacctgaacggcaagccgcagggcgaagtcagcgccgaagaaaagcgcgccgccgagctgcagatgcaaccgaaaaaccagccggcggccgatgccgccgttgcggagcccgttgcggctcaggtcgagatgtccgccgtagccgcggaacaaccgggccaggccgaatcctgatcgcccctcgatcccgacaaagccctgcgatatgcagggctttttgcatttccggcacttgaaaacgcctggccagcctccatttcacaggcattgccaacctcttttcattgccgaccatgagtgcacagaaagaaaccctgggttttcagaccgaagtcaaacaactgctcaagttgatgatccactccttgtactccaacaaggaaatcttcctgcgtgaactgatctccaatgcctccgacgccgccgacaagctgcgtttcgagggcctggccaagccggagctgttcgagaacgatgccgagctgaaaatccgcatcggcttcgaccaggatgcccgcaccctcaccatcgccgacaacggcatcggcatgagtcgcgacgaagtggtgtcgcacatcggcaccatcgccaagtcgggcaccaaggccttcttcgaacagctgtccggcgacgagaaaaaagacgcccatctgatcggccagttcggcgtgggcttctattcggccttcatcgtcgccgacaaggtgacgctgaccacccgccgcgccggcgaaaccgaagccgtccgctgggagtcgcaaggcgaaggcgagtacacgctggaaaccgtggaaaaggccgaacgcggcaccgagattgtgctgcacctgaaggaaggcgaagacgagctgctgaacgactggaagctgaagggcatcgtccgcaagtattccgaccacatctccatcccgatcgagatgaagaagggcaatagctacggcgaaaacggcgaagtgatcgtcagcgacgacatggaggcggtcaactccgcttccgcgctgtggacccgcgccaagaacgacatcagcgacgagcagtaccaggaattctacaagcacgtcgcccatgacttcaccgagccgctggcctggagccatgcccgcgtcgaaggccgccaggaatacaccgagctgttgtacatcccgtcgcgcgcgccgttcgacctgtacgaccgcgaacgcaagcagggcgtgaagctgtacgtgcgccgcgtcttcatcatggaagacaccgaaaagctgatgccgcattacctgcgcttcgtgcgcggcgtgatcgacagcaacgacctgccgctgaacgtatcgcgcgaaatcctgcaggaaagcaaggacatcgacgccatccgcaatggctgcgtgaagaaggtgctgggcctgctggaagatctgtcggccaaccagccggaaaaatacgctgcgttctggaaggagttcggccaggtgctgaaggaaggcgtaggcgaagaccacgccaacaaggagcgcatcgccaagctgctgcgtttcacttccaccgcgtcggaaggcagcgagccgacggtatcgctggccgactacatcggccggatgaaagaaggccaggacaagatctactacatcaccgccgacacgctggccgccgccaagaacagtccgcacctggaagtgttcaagaagaagggcgtggaagtgctgctgctggtcgaccgcgtcgacgagtgggtgaccggctcgctgttcgaattcgacggcaaggcgctgcagtcggtggccaagggcgcgctggatttgggcgcgctggaggacgaagccgacaaggaagcgcagaagcaggtggaagaggcgtccaagccggtggtggataaggtgcaaaaggcgctgggcgagcaggtgaaggaagtgcgcgccaccgcccgtctgaccgagagcccggcatgcctggtggcgggcgagcatgacatgagcgcccatctggagcggatgctgaaggccgccggccagaaggtggaaggcagcaagccgacgctggagatcaacccggagcacgtgctggtgaaaaagctggccggcgaaaccgacgaggcccgcgccgccgacttggcccaggtgctgtacgaccaggcgctgctggccgaaggcggcaagctggaagaccctgcctccttcgtcaagcgcatcaacaagctgatgctggagctgtcggcctgagtcaggctgagccggaatgacaggcaaaccgcccttgcgagggcggttttttattgccattgtcctaagatgggaatttcccaagcggatcgcggaggacgaaatgagcgagatcagagccttgcctggcgcatacccttgcctgtgctacgacgacgcggtggcggcgctggcgtggctggagcgggtgttctgtttccagcgccgtttcgcggcgatcgagaacggccgggttcatcattcggaactgagcctgggcaacgcggtggtcatggtgtccagccccaatcccgaccgcaactggatcggcgccggcagcctgcctggcctcgcccaggcgctatgcgtttacgtggcggatccggccgcgcattacgcgcgcgccagcgcgcaaggcgcggaaatcgtgcaggggctgaaaaaagaggattacggcgcgcacggttatctggcgcgcgatctggaaggccagcaatggtatttcagcgattatctgccgggcgaatactgggaatcctgaaccgttgatgcggcggcatccgcgtcatggcatcatgccgttttcattacgggagcgagcgatgcccgcgctgttgaaattcgccaccgccgagccgctgctgctgctgatagacatgcagcaggcggtggatcaccccagctgggggccgcgcaacaatccgcaggcggagcaggtgtgcgccaagctgctggccgcctggcgcgaacgcggcctgcctatcatccatatccgccacgactccaccgagcccgactccactttccggccggatcggcccggccacgccttcaagacggaaaccttgccgctggcgggcgaaaccgtggtcgccaagcagaccaacagcgccttcatcggcaccggcctggaggccatgctgcgcgagcgcggctggcgggagctggtggtggccggcgtcagcaccagcaactcggtcgaggcgacggtgaggatggccggcaatctcgggtttgcggtcagcctggtcgaggatggctgcttcgccttcgacaagaccgactggcagggaaggccgcgccgcgcggaggaggtgcatgcgatgagcctggccaatctgcacggcgaatactgtcgggtgtgcgccagcgccgacgcgctggccgcgcttggtaataatgccgaggccggcctgtcgtaagcgccatgccaaaaggctaagatgcgcaccctgtccgatttgtcattgtcattatgctgaaattgactgcctcccgcgattcggctcccggagcggagatggatctccatggtttgggcggcgagctgcgccggctgtccgggctggagacggctgaagcggcggccgcgctgctgcgcctgctggcgcgctgggaagaggcggcgcccaataccgccgcgctgcgcgcattgctgctggctggcgtggatttgcagcggcgcagcgaagacgccggcggccatggcgctttgacctgcccgttgtggcggcggctgcatgaggcgtgcaaacgcttggcggcagcggccggcgcgcagccggccggcttgttcgatcatggcaggccgcagcaggaggcgctggcgctggctttttccagcgcctggcaatcgctgcgcgcccacgttctcggctattcgcctttgtgcgccgggttttggcgcgattgccaccgcctgttcgccatggcgggccagcgcggctgggagcggcgcgcgcccggagacggcgccgtcgcgctgggcgattggtaccggcgcttgctgttgctgggcatgagcgccagcaaccggctggatgcccagcgccagcatctgctgctggactgggtggaaacatgcggttccgccttgaaactgacgccttggcgcggcgaagcgccggaacagccctgctggctggtgccggcagaggcagacatgcccggacgcttcgtcgatggcgaaagagaggcgccgggcgacgcgcgctggctggcagatgccggccccgcgctggagcgtctgcgcgggcaagcggaacggcgccggcagcagctgggcatggtcgaatggcagatgcttgcgcggctggaagcggagtggcgcagtccgccgcaacgccggcatccgcggctgaaccagcgcaacggccagcgggtggccttgctggcgggcttcgatgcttgctggcgtctggcgcgggcagggctgccgccggacgccgcagaggcggcggatctgttgctgggcaatctgagcgcgtccggcatgcggctgtgcggcgatttcggcccgcaggaggtgcaggccggcagcatcgcgatggtcaagcgccgcggtttcggctggcagctgggcctggtgcgctggatcagcctgccgggcggcgagcagccggccgagtgcgggatagagttcgtcggcaagcggccgatggcggtggaggcggcggcggtgaccagccacccggacggcggcatggaaaacggcctgctgctgcatggcgaacgcgatttccgccagcgcggcgtgctggcgctggccgggcggcgctatcaggcgatgcggcagttcaaggtgcgcggcgccggcggcgaatggctggtgcgggcgcaacggctgctgcagcagaccggtagctgccagctgatcgaggtgcggctggaggaaacgctggcgcgccgcgacgccgcatcatgagcgcgcgggatcgcggtagggataacacatccgctggctgccgtcgttttggcggcagtggatgctgatgatcctgccgttggccaggtccgcctgcaccgcgaaggccgcttcgtcgctggcaaagcccaggcggccgcgcggcggtgcgatcaggcggaaacggtagcggccgtcgccgccgtcgcggtcggcggcgaagcgcaacgcttcccgatgccccagctcccgttcgatgatgcggcggctgacttcttcgatctcgcgcttgcgccagaagtggcggcggtccggctccgccggccgcggctgatcggcggcaagctcggcgacgccgggcgcggaatcggtgtggcagccggccagcaggctcagcaggaaaaacaggcagggcagaagtggcggtttgtgtggcggcacgctggcgttgtctgaagggaaagcctgttggtgcgcgcggcggatgaaaagttcaaccgccgcgcgcggcgctagctggtatccttgtcgccatgaatgccgtgcccgatacccccgcgtccgccgatggccccgatttccagctgaccgcgcccgaactgccgcccagcgtgccgatcgcccatgtgttcggccagccggtgctggaagtgccgcaagacctgttcatcccccccgacgcgctgcaggtgatcctggaaagcttcgaaggcccgctggatctgctgctctacctgatccgcaagcaaaacctcgatgtgctgaacattccgatggcggccatcaccgtccagtacatgtcctatatcgacgtgatgcagcagggccggctggagctggcggcggaatacctgctgatggcggcgctgctgatcgagatcaaatcgcggctgctgctgccgcgcccgcaactggacgaagacggcgagccggacgacccgcgcgccgaactggtgcgcaggctgctggagtacgagcagatgaagctggcggcgctggagctggacaagatcccgcaggccgaccgcgatttcgcctggctggcggtgctggtggaacagtcggccgagcagcggctgcccgatgtcagcgccggcgatctgcgccaggcctggatggccatcctgtcgcgcgccaaacaccaccgccaccacaaggtggaaaaggacgagttgtcggtgcgcgagcagatgagctggatcctgcgctatctggatggccgcgaatacgtgccgttcgaggagctgttcgacatcgccaagggcgtcgcccacctggtggtcaatttcatcgccgtgctggaactggtgaaggaggggctggtgaaggtgagccaggatgcgccgtaccagcccatctatgtgcggatcgcgctggcgtgagccggatccgattggtcctggcccagcagcccgcgccggaagacgcctcccgccgcatgccgctgctgcggcagtggtgcggcgaagcggcggcggcgggcggccatctgctgctattgcccgagctgtggtctaccggctacgcgccggagaaaatgcatgaggtccacgcctgggatgacgatgcgccggacttggacggcgtcgcccggctggccgccgattttgggctcgccatcggcttcacgtatctcgcccgccgcggcggcgcgctgcgcaaccgcttgcgcctctatggcgccgacggccggctggcgctgcaatacgacaaggtccacatctgcggcttcaccgacggcgccgaaacggcgctgcaaggcggcgacggcttcgtctgcgccgatatcgcgctgggcggcgaaacggtgcgcgtcggcgcgatgatctgtttcgaccgcgaatttcccgaggccggccgcgcgttgatgcggcaaggggcggaattggtgctggcgcccaatgcctgcccgatgcgggacgatgccgagctgggcgacgcgcgcctgcagcagctgcgcggccgggcgctggaaaaccgcttcgccgtcgcgctgtgcaattacccggcgccgcaatacgatggcggcagcggtttgatcgacgcgcgcggccgcctgctggccttggcgggaagcgagccggccttaacgttggccgagctggacctggcggctttgcgccgctggcgcgccgagcaggacgaagtgtggggagaggccgccttgcggccggactgctaccgctgagcggcgatcatgtccttgtcatcgccgtgctatgatttgcggcaatggcccattgcggagatgaggatatggcgcagcatcaagcggaagtgatctggcggcgcggcgagcaggatttcctggaccgccgctacagccgcaagcatgtgttgaagttcgacggcggcgctcaggtggccggatcgtcggcgccgcaagtggtgccgccgccgtattccgacccggccgcggtggacccggaagaggctttcatcgccgccttgtccagctgccacatgctgtggtttctggatatcgccgcccgcgccggtttccgcgtcgacgaataccatgacgtcgccgtcggcgagatgggcaagaacgaggccggaaaggcctgggtggccagggtgacgctgcagcccggcgtctcgttttccggcgacagattgccgacggccgagcagttcgagcagctgcatcacgccgcccatgccgaatgcttcatcgcgcattcggtgaagaccgaagtgctgtgccggccccggctggcctgattgcggagattcccatgaaaaaactgttgatcctgctgacgctgctgttgggcagcgccgccgcgctggccggcgattggccgtacgacgaaaaggccgacgcccaggcggaattgcggcagactctggcggccgcgcagcaaagccatctgccggtgctgctgatcctgggcgccaactggtgtgaggactgccgcgcgctggacgcggcgctgaaaagcgggaagagcgccgaactgatcgcgcgcgccttcaaggtggtgaaggtggatgtcggcaatttcgaccataacctcgacatcgacgccgcttacggccacccgatcgccaagggcattccggccgcggtggtgctgtcgccggacaacaaggtgctttacgccacccgcgccggcgaactggccgacgcgcgccggatgagcgaaaccggcatttatgaatttttcgaacgggtcagccgtcaggccgcgcagtaagacggtggcgtttgacgatacttttcgccttagcgcccacgcggtgatcaccgacgccgccgggcgggtgctgctgctgaaggcgacctacggcgacctggcctggggtctgccgggaggcgcgctggaaccaggcgaaaccattcatgaatgcgtggcgcgcgagtgccgcgaggaactgggttgggaagtgtcgccgcgctatctgagcggcgtctattaccacagcgcctaccattctcaggccttcgtattccgctgcgaggcgccggcgggcacggagcccaggctgagtgccgagcattcggcctggcgctatttcgcgctggacgagctgggcgcggtgcagcgccgccgggtggaagactgcctgaactacgccggcgcggcggtcagcggccgcttctaagcgctcaggcgctccagttcacccagccggtttgccaactggccagcacgatcaggccgaaggcgatgcggtaccaggcgaataccgcgaagctgtgcgtggagatgaagcgcagcagcgcgcggatggccaggaaggcgaacacgaaggacgctgcgaagccgacggcgaacacgccgatatcgtcggcgctgagcgcgtcgcggtgcttgaagaggctgtacagcgaggcggcgcccagcgtcgggatgccgaggaagaaggaaaactcggtagccgccttgcgcgacaggccgaggaacagcccgccgatgatggtggcgccggagcggctggtgcccggtatcagcgccaggcattggcacaggcccactttcagcgcgtctttcaggctcagatcgtccaccgtttccaccgctatcttatgctcgcgcctctccgcccacagaatgatcaggccgccgacgatgaaggcgatggccacgcacaccgggttgaacagcgcggccttgatctgcttggaaaacagcagcccggcgattgcggccgggatgaaggcgatgacgatgccgagcagcaggttgcgctcgccgcctggacgtgccgcgccggccacggtgtggcctattttggcgcggtattcccacaccaccgccagcatcgcgcccagctggatgaaaatctcatagacgtcgcgcttgtccttgtcgaggaaatccagcaggtcgccggcgaggatcaggtggcctgtggacgagatgggcaggaattcggtgatgccttccaccaggcccatgatcagggaatgcaacagcaggatggggtccattgcgcgctcgcggggatgagagtggcgcgattataaatgcaaatggcaaaaatcgggcggtttgtgctgggcagtctcctctgatcgtgcaaatgttgcgggaaaaacgatgccgcgcctaagggcgcggcgtaaagaggagagcattgtgatttacagccggaagcgggtggtcacgttttgcagattggcggacagcgtgctcagctggctggaggtggtggccagttcctgcacggtggcgttgttttcctcggccatccgcgacactttttccatgtcctgcgccaggctcaggctggtgctgcgctgttcggtcagcgcgccggtgatgctgtggatggtgcgcatgatggtgtcggcgctgttttctatctcgcgcatcgagtgcgaggcctgctcggcggtgccggacacgccttccacgcagtccaggctctggcccatgctgtgcaccacctggccgacgccttgctggatcgagcctatcatcgtggtgatttcctgcgccgaggtggtggtgcgctcggccagcttgcgcacttcgtcggccaccaccgcgaagccgcggcccatctcgcctgcgcgcgccgcttctatcgccgcgttcaaggccagcagattggtctgatcggcgacgtcgcggatcaccgtgacgatattgcctatctgctgcacttccttggtcaggctgttcatctgcttggcggtgtcgtctaccgaggtagtgacgaagcgtatcttgcccaccgactccagcacttcgctgccgccgcggttggccagctggccggcggtctgcgcctgctcggatgcttcgctggaattgtcggccacctggttgatgctgaccgtcagctgttcgatcgaggcggcggcggaggtggtggcttccgcctgggtctgggcgccggtggccacctgctgcgccatgccggacaaggcgcgcgccgaatccgacacctggtgggcgttctcctggatgctcagcaccaccgcgcgcaggccctcgcgcatttcctggatgtcgcgggcgatgaccatggcttcgtcgcgcgcgtcggggatcggttcggagacgccggacaaatcgccttcgcggatctgatgcaccaagctggccgacttgcgcagcggcgaggtgatcaggtcggagatgaacagcgcgacggcgatggcaagcaatagcgaaaccagagcggtggtgagcaggatgttgatcgcctgctggctggagtcctgcgcgatgtccatcgatttttccagccggccctgctgccgttcgcgcagcgattgcagcgcagagatgaaggcgttgttggccggcgcgaacttgccgtccagcagctcgcgcgcggcgtcgctctggtggctgcgcatcagcgcgtacagcggttcgaacaatgggcgttgctggttttgggcatcgcggatcttggcgaacagcgcacggccttcgggttggcccagcagcggctccatcttgtccagatcggcctggttggcggcgcggatggcgtcgacattgcggatgtggcgctctatggcctggggatcgcgggccaacacgccgtcacgcacttcgcggccgatttgcagcaggttgagcgacaggcggttggacagcacgatcttgggatagcggtcctccttgatctcgctgacattgttctggatggtgaccagcttgctataggcgatgagaaccacggcgcagagcagcaggatcagcaaggcgaagccgctgagaagtttttggcgcacggtaagctgatgcagcatgcgtgtctcccgaatgcattgcgtaattacatataaatagttctagatcatcgcattgtggaagttcatacgcataaacgcgtatcgggagcgggggaggagccggcggcggccggctccggagggggtcaggcttgcagcgaagcctgcaggctggccgcgtagtcggctacctgttgcagcagctgccgttgggcggcggaaaggtcggatgcctgcaacgccgccagctcctcatggaaggccggggcggcgcgctggaggcgttcccggcaccactgccgccagcgcgcctgatcggcgccggacagcgtggcggggaagttgcgggcgcggtagcggaacaacagctcggtgagctgcggatcttcgaacagccccatttcgccggccagttgcagcgccgacagccggcgcattttctgcaacaccttgcggtcgttgttggaaacgaagccgccgtacaggttttcgtcgacgtcgcgcgcttcgccggcttcgcgctggaacaccccgcgccacagcggcgcgaggtcgggcagcgcgcgcgcggcttcagcgtggcgcgcgatggcggccatgtccacgccccagcgctcggcgcgttccgcgctcagcactttgaggttggccaccacgaacggcgacttgttgatgtgtatggtcttgatcggcagccgcgccacgccttcgggcaggtcttcgccgcggctaaatagccgttggcgcatggcttccgccgtcaggccgcgcagctcggccgggtcgtgcgccaggtcccagacgatgacttcgttggcgttggtcgggtgggccgccagcggccagaccacggccaggttgccgcgttccgcgccgtacatgccggagatgtgcagcaccggcttcggggcgtgcagcgatagctggaccttgaccgcgtctttcttgcgcagtgtcaggtagtagtcgaacagcttgggctggcgctggcggatcagccgcgccagcgcgatggtggcgcgcacgtctgacagcgcgtcgtgggcggcttcgtgcgccaggccgttggcggccgacaggtgctccagcttgaagctggtccggccatcctcgtgttcgggccagacgatgccttccgggcgcagcgcataggtggcgcgcaccagatccagcaagtcccagcggccgcaatggttctgccattcgcgcgcgtaggggtcgatcagattgcgccagaacaggaaacgggtgacttcgtcgtcgaaacgcagcgaattgtagccgacgccgatggtgccgggggtagccagctcccgttcgatcacgccggcgaattcgtgctcgtcgacgccgcgctgctggcacagctgcggggtgatgccggtgagcaggcaggcctgcagcgtcggcaggtagtcgggcgcctgccggcagtacagcatcaccggctcgccgatttcgttcagttcggcgtcggtgcggatgccggcgaattgggacggcctatcccggcgcggcacggcgccgaaggtttcgtagtcgtgccagaagaatgtgtgattggacatgggcggggcggcgtacggtgaagccgccattgtcgcatcgccgccgccggttcagccagccggacgggcttattccatccaggccggcttacgcatttcgatcagggcgagcatgccttcgcggccttcgtcgctcatccgcaccgtcaggctgtgctctatgcactgctgcatcacctgcggcgtgatgtcgtgctggccgatctcgcctatcaggtgcttggcggcgcgcatcgccgccgggctgttgagcagcaactggccctgcatgtgttcgaccgccgcgtccagctcgtcgttttccaccacctggtggatcaggcccagccgcttggccttgccggcgttgaagcgctcggcgctgatgcagtagcggcgggtggggcgttcgcctatcgcgcggatcaggtagggcgcggccaacgccggaatctggccgaagcggacatcggacaggctgaacagcgcttcggacacgctgatggcgatgtcgcaacaggccaccagcgccatgcccaggccgaaggccgagccctgcactctggccagcgtgggcttgggcagggtgtccagggtgtgcagcaggcgggcggtctgctgcgcgtagcggttgagctcgctggcggaaaactgcgacagccggcgcagccaatcggggtcgtgtccggcggagaagctgatgccctggccggtcaggaccaccgcccgcacgtcgttgtcctcggccagggtttccagcgtggcggccaagaggctgatggtttcgtcgtccagcgcgttgtgcaggtcggcgcggttcagcgtgacggtggccacgccctgtttgttgacgctcagcaatacggcttcgttgcccatgagttctccccctgatggatggccgcgtcagcgcgggctgaattgaatgatgccgcgggcgaaagcctccacggcttcgatgtgcagtacatggccggcgccgggaaggatttccagttcggcgtccggaatcagactgtgcagcagcttggcctggtacaagggcgtcagccggtcttcgtctccgaccagaatatgcaccggtagttgcagctcgggcagccaggtgcgggcatcgtgctggcgcacgccgtcgatcaggcggatcaccgcgtcccagtccaccatgccggccagcattttcagatcgtccagcatcgcggcgttgctggccagaaagcggctggaaaacagccagggaatgctgacctggtagcgcaggtccagtccgccttgctgattggcggcgatccagctgtcgccgatatggccgttgacgctgtcggcccaggccagggtgccggcgagaaacagccggctggctcgttccgggtggcgatggacgaagtgctgcgccaccatgccgccgtaggacaggcccaccaggtagacctgttctatccccagcagctccagcagggcggcggcgaggtcggcctgctcggtcaattggtagtactcggccggcggatggtcgctctggccctggccgagaaaatccatccgcagcaggcggaagtggggctccagctgcggcagcatcagcgtccagcccaccgtggacatggtgatgccgttgaacagcagcagtgtctggccgccatggccgctttcctcatagtacacctggcgtccgtctatctgggcgtacggcatggcaagctcctgtttctggctgcggtgctattcattctagaacccgtccggcatcgctgaacaggtggggcgcgcaaatcgcgcgatgtaatgtctttgacatttttctggcttagattatctcgttcgaacgaaatcaggctgttttcccaagatcatgcaaagttgcgtcgagccgctcctgtcccccggggcggcgggctggtgtcaggagctggaggaaatcataggcaggcgcaggctgcagccggtattccagcctatcgtcgatctggacgccggcagcatactgggctacgagggcctgatacgcggcccgtccgacagcgcgctgcattcgccgatgatgttgttcgaggcggcggagcgctgccggatgacgctgccgctggacctggcctgcctcagggcctgcgccgagcgcttcgcggaactggcgctgccgggcctgctgttcgtcaacctccacccggagacgttgttgctgcaagggcagcgaccggcttccatcctgggatttctcggccagatcggcctggacagcaagcgcgtgatcctggagttgaccgaaacccggccaaacggcggctatctggcgctgcgcgaagtcaccgccgcctgccggcagggcggcctgcgcatcgccttggacgacctgggcgaaggcttctccaatctcaggctgtggtcggagctgcggccggatttcgtcaagctggacaagcatttcgtgcagaacatccatctggacccgctgaaggagcagttcgtccgctccatcgccgacatcgcccgccagtccggcgcgctgctggtggcggaggggatagagtcggcggcggagctgcgcacgctgtgccggctgggcgtccgctacggccagggctatctgctggcccggccccaggccaatcccgcccacgcgttgcccttgccggcgcacgcgctgccatgggccggcaaccgccgccagggcctgcgcaaccagccgctggcgcgcgacctgctgctggaggtggcgccgctggaggcgcgggtgcccaatgaaaccgcttaccgccgtttcgccgaccaccccgactgtttcgccattccggtggtggaggatggcgtgccggtggggctgctgcgccggcaccacctgctggaaagcttcgccaagccgttcaaccgcgagctgtacggcaagaagccctgccacctgatgatggacaagcagccgttggtggtgagcgccgacttgaatgtgcatgaattgtccagcctggtggtggcggccgagcagcgctatctggtggacggcttcatcatcacggaaaacggtcgctacctgggcatgggcaccggcttcgcgctgatgcgcaagatcaccgagctgcagctgtcggcagcccgctacgccaacccgctgaccggcctgccaggcaatgtgccgatcaacgaggccatcgaccgcctgctgggcatgaagacgccgttcgtcgcagcctacgccgacctggatcatttcaagccgtttaatgatttatacggctatgccgccggcgacagcctgatcgaactggtggcccacctgttgctggagcatgccgacccggaacgcgatttcgtcggccacgtcggcggcgacgatttcgtggtgctgatgcaggcggacgactgggaggcgcgcctgcaatgcgtgctggaagcgttcggccggctggccgcgccgcatttttccgaccgccaccgcgaggccggcggcttcgaggtggcggcgcgcaacggagagacagtgttccagccgctgacgacgctgtccctgggcgtggtgcgggtgaagccggggcagttcggcagccatcacgagatcggcgcggtgaccgccgaggccaagaagcaggcgaagaaaatccccggcaacagtctgttcgtcgaaagacgccagcccgccgcgacggttgccggctgccgttgcggcctggccgagggcggcggctgaggcgggaaaacgacagcgttgtcagacaattactacggcaactatctccgccacttgtcaaatttattaaacatggcataggctgtccccaaaagccgccgcatccgacgacggccgcgctgtccgcaggacggcagataaagaggagacatcatggcccgttccattcgtttgctcgcgccgtccccgccgcgccttcccgctcgcttttcgcttaacttcgttgcatctttatcaggcagggctggccgtgctttgccatgctggtagcgcgtagcccgtcgctgcccgccgcggcatagcccgtttcttgcccggttccattcattcgcaggccgcgtgccatccatcggcatcgcgcctgcccggggttagagttggagggagtcagatcatgtcggaagccattgcggccacgaaacacgtagcagccattcccgccgtcggagccgtttccggcgtcagcggcaacgaggaggccccgtatctgaagattgccggggtggtgaagaaattcggcgaacacctggcggtggatcacatcgacctagatatccgcaaaaaggaaatcttcgccctgctgggcagctcgggctgcggcaagtccacgctgctgcgcatgctggcggggatggagacgccaagcgccggccgcatcattcttgacggccaggacatgcatggcctgcagccctaccagcgcccggtcaacatgatgttccagaactacgcgctgtttccgcacatgacggtggaagagaacgtggccttcggcctgaagcaggacaaggtgccgagggacgaaatcgccgagcgggtggcgaaaatgctggacctggtgcagatgcgcaagttcgccggccgcaagccgcatcagctgtccggcggccagcagcagcgggtggcgctggcgcgcagtctggtgaagcggcccaagctgttgctgctggatgagcccctgggcgcgctggacaagaagctcaggcagcagacccagctggagctggtcaacaccatcgaggcggtcggcgtcacctgcatcatggtgacccacgatcaggaagaagcgatgacgatggccagccgcatcggcatcatgagcgagggcaaactgctgcaggtgggcaccccgaccgagatctacgaatacccgaattgccgcttcaccgccgaattcatcggcgagaccaatatgctggagggcgcggtggcggtggacgagccggacttggtggagatccattcgcaggagctgggcggcgtgatccgcatcgagcacggcatcacaggccccaagggcatgcacgtgtgggccagcgtgcggccggaggacgttcggctggacaagcagcccttgccgcccggccccaaccgcgccgccggcacggtgcaggatatcgcctacctgggcagttattccatctatcacgtgaaactggcgggcggcaaggtcgtcaaatccatcgtgccgtcgtcgcgctggtgcgacgccaatgaaacgccgcccacctggggagacccggtgcatgtcagctggcgctccgacgcgccggtggtgctgacccagtaacacgcctgcctgtccggccccggcttgccggggcctatccgcaatcgacatcgaggaatccatgctgcgcttcgctcatcagccgcatccgccatcctattacgccgccaccgcccacgcctgggatccgcagccgccgctgcgcggcgaggccagctgcgacgtatgcgtggtgggcggcgggctggccggcctgtcggcggcgctgaacctgcgcgagaagggtttctcggtgattctgctggagggctcgcaggtcggcttcggcgcctccggccgcaacggcggccaggtgatcgccggctatgccggcgatatcgacggcatccgccgccagctgggcgacgaggcggcgcgggcgctgtgggacatgtcggtggaggcggtggagatcatcgacgagcgcgtgcggcgccacgccatcgcctgcgactggcagcgcggctacgtcaacgtggcggtgaagccccgccatctgcgggaattggaagactggcagcgcgaggccgagcagcgctacggctatggcggccagcagctgtgggaccgcgccgcgctgcgcggcaaactggccagcgaacgctaccagggagggctgttcgacccgcgctccggccatctgcacccgctcaactatacgctgggcctggcccgcgcggcgctgggggccggcgtggccatccatgagcagacgccggcactgcgcatcgagcagggcgacgcgcccaaggtattcaccgagcacggcgtggtccgctgccgccaactggtgctggcctgtaattcctacatcggcgcgctggcgccgcagctggagcggcgcatcatgccggccggcacctatgtgatcgccaccgagccgctgggcgaggcgagggcgcgcgcgctgatcgccgacaatatggcggtgtgcgacaccaatttcgtgctcgactactaccggctgtcggccgaccaccgcttgctgttcggcggcaaggtcagctattccggccatgagccgcgcgacttggccggcgccatgcgcgccgacatgctgcgcgtgttcccgcagctggcggacgcgcgcatcgattacgcctggggcggcttctgcgacatcaccgccaaccgcgcgccggacttcggccgcttgtcgggcaacgtctattacctgcagggtttctccggccacggcgtcaacatcaccggcctggccggcaaggtggtggcggaggccatcgccggcacctcgtcgcggctggacctgttcggcaagatccgccaccgcgactttcccggcggcaagttgttgcgcaccccggcgctggtgttagggatggcttactaccggatgcgggattatctgtagacagcgccggcgtaggcgttatgtctgaagcccgggcatgcgagagtgtgctcgggctatttacttactgcttgtttgctggaacataattgctggtttatttgcggtattgtgctgatttttaagagttgaatttttaggggtgtaggtcgagctgggcttgataggcccgacgtttatcgcgatgtatggcgattagtatttatggggggcctgggttttctcggtaaacgttgggcttcattttattcagcccaacctacggcccttgggttcgtcatatctacgatttacgcgttggccaaagcaagctgtggatacagatggccgcatggtgtttgaatgcgattcaggtcgcggtcgtattgatatagagaagagctggttgagccttgatgacaaggggcgacattatttgctggaatgggcagagattcatgatattgatttctgctatggatccagagcgagcaagccgagattgatcatcgaattgaaaaaggcagcaacgcctaagcttcagccgccggaggctaggcaaatagaaattttggcgatgggttgcaaggtcgatgcgcaatatatttgccaagtcctgagggcctttcttgttgagcatggacaaacgcaacgggctgacaaggccgtttgactctgcgcatcttggggtgatctgggacgcggcagctgtgaagcctgatgtttgccacagcagtgttcctgcagcaggcaaaatgaatcatgtccaatcgtgagccagactgtatcgctggccaggcccactgtgcgatgacgcatgtaggcgcagaagtctatgcgcgtcggcagaacgcccggcaaggccgggcttcttccctacagggcctgtttcagaaagcgaatgaccgatggcgccagcgttggcgacaacggctgcggcgttgcgccgtaggaggcttgatgctgcggatcgtcgtcgcgcagcaggtgattcatgccggggatgttttgcagcaggctgtccggcttggccgcgtgcagcgtttcgccttccgccttcggcacctgatggtcggcgccgccctgcacgatcagcgtcggcgctttcagcgcgcggatggcctcggtgggagtgtagcggaaccacgaaatcagatagggctggatgctggggcggtacaccaccagcagcgggcctggaacgttgtcggcttcgcggccctgccgcagcgcttgcagaatccgctcgctctgcttggccagatcttccggcagccgcggcgccagctgggctcgcaggaaatcggccgcgttgcgcgccgggccgtccagcgaaacgaacgcggcggcgttctgcttctgcgcggccagcatgccgatcagcgagccttcgctgtggccgatcaccgcgaccttggagaagcgcgggtcggttttcagcttggcgatccagccggccgcgtcgtccacatagtcgtcgaaatgcagcgccgcctcgtccaggccggcggcgcggctttcgcctatggcgcgtttgtcgtagcgtaccgaagcgatgccggcgtcggccaaggcctgagccagctgtttcagatagccgccgctgccatagggcaggccgggattgtcgccgtcgcggttggtcgggccggagccggcgatgatcagcgcgaccggcgctttgccggggggctccggcaacagcagcgagccggcgatgcggccactggcggtatccagcgcgatgggcaactcgttcgcggccagggcgggcctcgccagcgcggcaagcagaacggcgtaagggagtagacgcatgatgggctcctgcagggaaacatccatcatatggcgcggggtattgctacgtcatgaagcgtcgccgccgcagacgccggccgtggctgcggcgcgacaatcttactgcccgcgcatgaacagcttgtccaggtcgcgcatggtcagccggctccaggtggggcggccgtggttgcactggccggagcgctcggtggcttccatgtcgcgcagcagcgcgttcatttccggcagggtcagctggcggttggcgcgcaccgcgccgtggcaggccatggtggccaacagctcgttgcggcgttcggtcagcacttgggtcaggccgaactcgcgcacgtccttcagcaccgctcgcgccaagtccaccggatcgccatccttcagccacaccggcacgccgcgcacggcgatctgcgtcggcgacagcggcgccagctccacgcccagccgtttcatctcttcgccgtgctcgtgggcggtggccacttccatgcggtcggcggcgaacgataccggcagcagcagcggctgctgcgggatggcgtccgattccagcgcggttttcagccgttcgtagacgatgcgctcatgggcggcgtgcatgtccaccagaatcagcccttcggcgcattggctgaggatgtagacgccgtgcagctgggccagcgcgaagcccagcggcgggatgccgttttcgtcgtgcgccggcatcgccagcatcgccgggtgcggcagcggcgcggcgggggagggcatggccggctcggcgcgcgacagcgcccgttcttcctcgcgcaggccgccgaacatcttgtcgtagacgcctacggcctcgcgcgcgacgttcagcgggatggactgctgttgatgatactggaaagcttgcggcgccggcgcgccggacgaggccggccggggcgcggggctggcgaacagcggggccgactcgccgcgcggcagctgcggcgcggccggttccgcgccttccacctgcaccgtcggagcggcgccggcgctggtgccggccaatgccttgtgcacgctgtggaacaggaattggtgcacggcttgcgattcgcggaagcgcacttcgatcttggtcgggtgcacgttgacgtccacgccggacggctcaagcgtgaagaacagcgcgtaggccgggtggcggtcgtggtgcagcacgtcgcggtaggcttggcgcagcgcgtgctgcgcggtcttgtcgcggacgaagcggccgttgacgtagaagtactgggcgtcgcggctggccttggagtaagtgggcgaggcgacgaagccggtcagcgccagcgggccggcctggctgtccagtggaatggcggcggcgacgaagtccttgcccagcagcgcggccacgcggtcctcggcgctttgcgacggcagccgccacgctaccttgccgttgtggcgcagcaggaattcgacatgcggatgcgccagcgcgatgcgctcgaaagtggccacgcagtgcgcgtactcggtgttttcgcttttgaggaatttgcgccgcgccggggtgttgaaatacaggtccaccacttccacgctggtgccgtgcggatgtgcggccggctccaccgggtgcagcgtgccgtctatcgcgatgatctggtgcgcgtgatcggcgtcttgcggccggctcaccagcgtcagccgggacaccgacgccacgctggccagcccctcgccgcggaagcccagcgtgcccaccgattccaggtcgtccagcgaggcgatcttgctggtggcgtggcgatccagcgccagcggcagatcatccgccgcgatgccggcgccgttgtcggtgacgcggatcagcttgatgccgccctgggccagatccacgctgatccgcgtcgagccggcgtccaggctgttttccagcatttccttcagcgcggaggcggggcgttccaccacttcgccggcggcgatctggttgacgaggtggtcgggcaggcgttggatgcgtttcatgggcggcgttgtggcgtggtatcaaagcgaaaggccgcccttggggcggcctggtcgattttactacggattacgacctggcggccgcgcgcttgtggcgcgcgaattcgatgatggccggcaggaaggagacgaagatgatgcccagcaccagcagttccaggttcttgcgcacgaagggcagattgccgaagaagtagccggcgtagacgaagctggccacccagatcaccgcgccggccacgttgtagatggtgaactggcggtagcccatcgcgccgatgccggcgacgaagggggcgaaggtgcgcaggatgggcgcgaagcgggtgaagatgatggtcttgccgccgtggcgcgcgaagaaggcgtgggtcttgtccaggtagtcctgcttgatcaggcgcgggtagcgctgcagcagcgctttgcccaggtagcggcctatggtgtagttggcggtgttgcccagcacgccggcgacgatcagcgtggcggtcagcgcgtgcacgtccatcttgcccatcgcggccaaggcgccggcgacgaacagcagcgagtcgccgggcaggaagggcgtcaccaccaggccggtttcgcagaagatgatcaggaacaggatggcgtagatccacgggccgtagtcggccaccagttgcgccaggtgggtgtcgatgtgcaggatgaaatcgatcaggaatgtcagaacttccatgagggttccagtgcgtattgcggggtgggcgggacaaaaaactggccggacaaggccggccagtcgttcagtgggcggaggtcagactaccgcttcctcttttggtttcaccggcttgatcatgtgctcgcgcgtcacgcccagccacagcgcgatcgggctggccaccagcaccgacgagtagatgccgaacaggatgccgatggtcagcgccatcgcgaagccgtgcagcgccgggccgccgaagaccagcatcgacaccaccatcatctcggtggagaagtgggtgatgatggtgcggctcatcgtcgaggtgatggcgttgtcgatgactgaggccaccgcctggccgcgcatgccaggcttgcggaagttttcgcggatccggtcgaacaccaccaccgactcgttcaccgagtagcccagtaccgccaggatgccggccagcacggtcagcgagaattcccagcggaagaaggcgaagcagccgaggatgatcaccacgtcgtgcatgttggcgatgatggccgccaccgcgaagcgccattcgaagcgcagcgccaggtaggccatgatgcccaggcacaccaggatgacggcggtcaggccgctggacaccagttcggcgccgacgctggggccgacgaagtccaccttgcgcagctgcacgctgctgtcggcggccttgagctggcccatcaccttgtcggacagttgggccgagctggtgcccggcttgttcggcaggcggatcatcacgtcgcggctgctgcccaggttctgcacggtggcttcgcccagcttcaactggtcgacggtgtcgcggatcttgtccaggtcggccgattgctggtattgcacttccagcacggtgccgccggtgaattccacgctgaaattcaggccgcgggcggccaggaagaataccgccacgatgaaggtcaccagcgagatcgccgtggtgagcctgccgtagctcatgaacgggatgtcccgtttgatgcggaaaagctccatgatttagcccttgttttccggtttccacacctggccgatggccagcgaggtcagtttgcggcgacggccgtaccacaggttgaccagaccgcgcgaaaccagcaccgccgagaacatcgaggtcaggatgccgaggcagtgcacgatggcgaagccgcgcaccggaccggtgccgaagatcatcagcgccaggccggcgatcagcgtggtgacgttggagtccaggatggtggcccaggcgtggccgtagccggcctggatcgccgagtgcggcggcacgccgttgcgcagctcctcgcggatgcgctcgttgatcagcacgttggcgtcaatcgccatgcccagcgccaacgcgatggcggcgatgccgggcaaggtcagcgtggcctgcagcgcggacaggatggccaccagcaggaacacgttgatcgccagcgacaggccggagaacacgccgaacaggccgtagtacagcaccatgaaggcgacgatggcggcgaagccccacagcgtggcgtggaagcccttctcgatgttttcctggcccaggctcgggccgatggtgcgttcctcgatgatgttcatcggggcggccagggagccggcgcgcagcagcagcgcggtgtcgttggcttcggcggcgttcatgctgccggagatttccacgcggccgccgccgatttcctggcggatcaccggcgcggtcaccacttccttgcggcccttttccaccagcaccatcgccatgcgcttgccgacgttctcggcggtgagctggcggaagatggcggcaccggcgctgtctagcgtgatgctgacggcgggcgcgccgaactggtcgaagctggggttggcgtcgttgatgttgtcgccggtcagctccacgtcgttcttcagcaggatcttgctgtggccgcgcgagctgacgtcgtccagcagttcgtagccagagggaacgttgccgttgacggcgtcgctcagcttgccttggtcgtcttccaccatgcgcacctgcagcgtggcggtgcggccgatgatgtccttggcgcgggcggtgtcctggatgccgggcagctgcaccacgatgcggttggggcccgcctgctggatgatgggttcggtggtgcccagctcgttgacgcgattatgcagcgtcatgatgttctgcttgaccgcgtcgctctggatcttggtgatttcttccggcttcagcgtcagcagcaggcggttgctggcgtcgtcggtttgcaccgccagggtcggcagcgtgcggtaggccacgtcctgcgccgatttcagcgtgtcgccgtcgcgcagctgcacttccagcgtattgccgttgcgcttgatggcgccgtagcgcacctgcttgttcttcagctcgcggcgcagatcgcctgcgtagcgttccatggtcttgtcggtggcggccttcatgtcgacttccagcaggaagtggacgccgccgcgcaggtcaaggcccaggaacatcgggttggcgtgcagcgcggtcagccaggcgggggaggccggcagcaggttcagcgcgatgatgtagttgtcgcccagcgcgtgctggatggcgtcgcgcgccttcaactgggtgtcggtgtccttgaagcgcactttcaggctgttggcggcgtcgaggaagacgccgtcaggactgatgttctgcgctttcagcgcctcttccacccgcgccatcactgcggtgtccaccgggacggactggcgcgaactggagacctgcacggcgggggtttcgccgtagaagttgggcagcgtgtagatcgccgacaggatcagcgccaccacgatgacgaggtatttccagagagggtagcggttcatgttctagttctggggagggaaatgaacaggccgccgcggacgatgtccggggcggccggggcttgcttacagggacttcatcgtgcctttttccagcttggcgctgacggcgccgcgctgcacggtgatttccacgccgttggcgatttccagggtcaggtactgctcgctggttttcgccacgcggccgacgatgccgccctgggtgacgacttcatcgcccttctggatttccgacagcatcttctgggtttccttcatgcgcttctgctgcgggcgcaccatcaggaaccagaacagcacgaaaatcacgatcatgggcaggaagcccatcaggtcgaaaccggcggggctgccgctgccggcggcgaaggcgggggagatgaacatcaggatgactcctagttgttatggctgctgattcaaacagggcattgtagccatgctccatggcttttccaaccatggagcgcggcagcggcgtgggaccgtttccggcgccgcctggttccctgctttaattaattgacgccgcgcgcgcggttggcggcgaactccaggcggaagtcctcgaagcggtcgtcttcgatggacttgcgcacctggcgcatcagttcctggtagtagaacagattgtggatggtgttcaggcgcgcgcccaaaatctcaccgacgcggtgcaggtggtgcaggtaggcgcggctgaagttcttgcaggtgtagcactcgcaagcctcgtccagcgggcgcttgtcgtccttgtagcgcgcgttcttgatcttgacgtcgccccattgggtgaagatccagccgttgcgcgcgttgcgggtcggcatcacgcagtcgaacatgtcgacgccgttggccacgccgtgcaccaggtcttccggcgtgcccacgcccatcaggtagtgcggcttgtcggccggcagcatgtccttcagttcagtcagcattcggtacatttcaggcttgggctcgcccaccgacaggccgccaatggcgatgccgtcgaagccaacctgcagcaggccttccagcgactcctggcgcaggtcggtgtacagattgccctgcacgatgccgaacagcgcgttcgggtttttcaggtcgtcgaaggcgcggcgcgagcgctcggcccagcgcaggctcatctgcagcgatttctgcgcggtggcgtggtccacctggccgggcgtgcattcgtccagctgcatcacgatgtccgaattgagcacggtctggattttcatcgagatttccgggctcaggaacagcttgtcgccgttgatcgggctctggaaggtgcagccttcctcggtcagcttgcgcatgtcggacaggctgaacacctggaagccgccggagtcggtgaggatggggcggtcccagcctatgaattcgtgcaggccgccgaattgctcgacgatctcaagcccggggcgcagccacaggtggaaagtgttgcccaggatgatctcggcgccgatatccttgagctcgaccgggctcatcgccttgaccgagccataagtgcccaccggctggaaaaccggggtttccacggtgccgtggttcagttccagcgtaccgcgccgcgcgccgccggaggtcttgtgtacggtaaacttcagcattctggatatgtttttttagcaaaatcagtccgctagtatacaggaagcgcggcatgtgcggcgcatctggaaaattgttcttgccaagagaggcgcctttctttattattcatcactcgacgacaggcacgtagctcagttggttagagcaccaccttgacatggtgggggtcgttggttcgaatccaatcgtgcctaccaaattcaatgcatggagttgccaagtgaatttcttgcgaactaccaccacccgacatactcaccaaagctgagccttgcgggttgtaccatgcgaaaaagaagtgcggctcaggccgcactttttttttaccctttttttctgaattcgttttagattcgatcacacaaaatactcgccctcgttggagttgatatgccagacattcgcttgccggacggctctatccgttctttcgacaaaccggtaacggtccatgaagtggccgcctccatcggcgccggcctcgcgcgcgccgcgctggcgggccgcgtggacggcaagctggtggataccagcttccagatcgacggcgacgccgatctggccatcatcaccgacaaggacgccgacggcctgtccgtcatccgccactccaccgctcacttgctggcttacgctgtcaaggagctgttcccggaggcgcaggtgaccatcgggccggagatcgaaaacggcttctactacgacttcgcctacaagcgtccgttcacgccggaagacctggtcgccatcgaaaagaagatggccgaactggccaagaaggacattccggtggagcgttacgagctgccgcgcgacgaggccatcgcctacttcaagtcgatcggcgaggcgtacaaggccgagatcatcgaatcgatcccgcagggcgaagtgctgtcgctgtaccgcgagggcgaattcaccgacctgtgccgcggcccgcacgtgccgtccaccggcaagctgaaggtgttcaagctgatgaaggtggccggcgcctactggcgcggcgacagcaagaacgagatgctgcagcgcgtctacggcaccgcctgggccaagaaggaagatctggaagcctacctctatatgctggaagaggcggaaaagcgcgaccaccgcaagctgggcgtgcagctggacctgttccacctgcaggacgaagcgccgggcatggtgttctggcatccgaaaggctggcagctgtggcagagcgtcgagcaatacatgcgcgacaagctgaaccgcgaaggctataaggaaatccgcaccccgatgatgatggacgcccatctgtgggagcgttccggccacgccgccaactaccgcgagaacatgttcatcaccgaatcggaaaagcgcgactatgcggtcaagccgatgaactgcccgggccacgttcaggtattcaacagcggcctgcgctcttatcgcgacctgccgctgcgctacgccgaattcggttcctgccaccgcaacgagccgtctggcgcgctgcatggcatcatgcgcgtgcgcggcttcgtgcaggatgatggccacattttctgtaccgaagaccagatcaaccaggaggccaaggacttccaccgcctggtgatggaagtgtacgaccgcttcggcttcgacaaggtgtcgatcaagctggcgctgcgtccggaaaagcgcatcggcgaagagtccacctgggacaaggccgaggaaggcatgcgcgaggcgctgcgcgcctgcggcgtcgagtgggaagagctgccgggcgagggcgctttctacggtcccaagatcgaataccacatcaaggacgcgctgggccgctcctggcagtgcggcaccctgcagctggacttcatgctgccggagcgcctggatgccgaatatgtggccgacgacaacagtcgcaaacgcccggtgatgctgcaccgcgcggcgctgggctcgctggagcgcttcctcggcattctgatcgaaaaccacgccggcgccttccccttgtggctggctccggtgcagctggtggtgatgaatatcaccgaagcgcaggccgattatgctgttgaagtggccaaatctcttgagaaacaaggcttccgtgttgcgcttgacttgagaaacgagaagatcggctataaaattcgcgaacacagcctgcagaagttgccgtatcagatcgtgatcggcgacaaggaaaaggcaggcggtctggttgccgtgcgcgcccggggcgaagatctgggccagctcacgctggatgcgttcatcgcgcgcctcaaggctgagatgcctgaggcctgatccagcggcggcatactcatcatttattaggagatttcagctatagctcaggaacgcgaagcacggatcaacggcgagattaccgctcgtgagattcgtctggtaggtaaggaaggtgagcagattggcatcgtcagtctgcgtgaagcaatggctctggccgaagagggtgatgtggacctggtggagatttccccgaccgctcagcctccggtgtgcaagctgatggactacggcaagtacaagtacgaaatgtccaagaagcgccacgaagccaagcagaagcagaaacaagttcagatcaaggaaatcaagttccgtccgggcaccgacgatggcgattacaacgtcaagttgcgcaacctggttcgtttcctgactgaaggcgacaaggccaaggtcactctgcgcttccgcggtcgtgagatggcgcaccaggatatcggcctcgcgctgctcaagcgcgtggaagccgatctggcggaagtgggcacggtggagcagttcccgcgcctggaaggccgccagatggtgatgatgattgcaccgaagaagaaataatcggtataatcgtttttccgacacggcagactcagctctgccgtgtcggttttgtaggtcggcaacgatctgctcaaaagcgtgacgcagtggtttcaagagctttcgggccaccctgtgtctaatctaaacaaaattcagcaggagcatttccatgccgaaaatgaagaccaagtcgagcgcgaaaaagcgtctcaaagtactgggtggcggtggtttcaagcgtgcacacgccttcaagcgtcacatcctgaccaagaagaccaccaagaacaaacgccagctgcgcggcacctccatggtggacgcgaccaacgtggcgtctgttcgcgcaatgatgccctacgcttaaggagacctgaaatatgccacgcgtaaaacgcggtgtaaccgcacgtgctcgtcacaagaaaatcctcgcactggcgaaaggctatcgcggccgccggaagaacgtctatcgcatcgccaaacaggcggtgatgaaggcgggccaatacgcctaccgcgaccgtcgtcagaaaaagcgtcagttccgtcaactgtggatcgctcgtatcaacgcagctgcccgtgaaaacggcctgccgtacagcaagttcatgaacggtctgaagaaagccggcatcgaaatcgaccgcaaggtcctggccgatctggccgtgttcgaaaaggccgcttttgcgcagatcgtcgaaaaggcgaaagcaagcctcgctgcttaatcgtctggacggatctaaagggaggcttctgcctcccttttttttgccatcggcgccctggcgccgcaagaacgctgattagaccgggtgcggcaagcgcctgctgtggtcagccttcttttcgcatacggtgtggaacacgatgaacaacgtcgacgcgattctccaagccggccaggcggcagtcgccgccgcggccgatctgatagagctcgagcaggtcaaggcgcgctaccttggcaagagcggcgagctgaccgaactcctcaagcaactgggcaagctggcgccggaagagcgcaaggccgccggcgccaccatcaatctggccaagcaggcttttgaaaccgcgcacaacgacaagcgcgatcagctcaacgccgccaagctggaagcccagctggccgccgaggtgctggacgtgacgctgccgggccgcggcctggtcggcggcggcctgcacccggtggcgctgacgctggagcgcatcgccggcctgttccgcaccatgggtttcgaagtggccgacggcccggaaatcgaaagcgatttctacaacttccaggcgctgaacattccggaaaaccatccggcgcgcgcgatgcaggacacgttctacgttgaaaacggcgacgtgctgcgcacccataccagcccgatccaggcgcgcttcatggaaagccatcgcccgccgatcaagatcgtcgcgccgggccgcgtctaccgcgtggattccgatgcgacccactcgccgatgttccaccagatggaaggcctgtgggtggatgagggcgtgtccttcgccgacctgaaagcggtggtcaccgacttcctgcgccgtttcttcgagcgcgacgatctgcaagtgcgtttccgtccgtcttttttcccgttcactgaaacttcggccgaaatcgacgtgctcgacgagcagggccgctggctggaagtgggcggttgcggcatggtgcacccgaatgtgttgcgtatcgccaacatcgatccggaaacctacaccggcttcgccttcggcatcggcctggatcgtttcgccatgctgcgctacggcgtcaacgacctgcgcctgttcttcgagaacgatctcaacttcctgaagcaattcaactgatcgcgcacggagccgactatgcaattttccgaacaatggctgagaagctgggtcaatccggcgctgaccaccgatgaactgtcccacctgctgacgatggcgggtctggaagtggaagaaacgcaagccgccgcgccggcgttctccggcgtggtgatcgccgaggtgaaagagtgcgtcaagcacgaaaacgccgaccgcctgcgcgtgaccaaggttgacgtcggcagcggcgagctggtgcagatcgtctgcggcgcgcccaatgtcgccgtcggcgtgcgcattccctgcgcgctgccgggcgcggtgctgccgggcgacttcaagatcaagccgaccaagatgcgcggcgtggaatcgggcggcatgctgtgctccggcaaggagctgggcgtgccggatgatgtggacggcctgatgctgctgccggacgacgcgccgatcggccagaacatccgcgagtacctgggcctggacgaccagctgttcacgctgaagatcacccccaaccgcgccgacagcttgtcgatccgcggcatcgcccgcgaagtggcggcgctgaccggcgccgagctgcgcccggtggcgatcgaggcggtgaagccgtccatcgatgacgtgcgtccggtgaagatcgaggcgcgcgaggcctgcggccgctacctgggccgcgtggtcaggggcgtcaacgccgccgcggcgacgccggcctggatgcgccagcgcctggagcgttccggcctgcgttcgatctccgccatcgtggacatcaccaactacatcctgctggagcagggccagcccatgcacgctttcgacctggccaaggtcgagggcggcatcgccgtgcgcatggcgcgcgcgggcgaaagcctgctgtgcctgaatgagaagactgtcgagctgaagccgcatcatctggtgatcgccgacgacgccaaggtattggcgatgggcggtttcatgggcggcgagcacagcggcgtcaccgccgcgagccaggacattttcctggagtcggcgttctttgcgccggccgccatcgccggccgcgcgcgcgagctgggcttcggctccgattcgtcctaccgctacgagcgcggcgtggactttcagctgcagcgcgaggcgatcgaatgcgccacccgcctggtgctggacatctgcggcggcgccgccggcccggtggtggaagaggttgccgagctgccgcagcgccaagaggtgaagctgcgtgtcgcccgcgtggccaaagtgctgggcgtggcgctgagcgccgagcagatcgccgacatcctgtcgcgcctgagcctaccgcacacgctggaaaacgacgtgttcaccgtgcaggcgccatcgttccgcttcgacatcgagatcgaggaagacctgattgaggaagtggctcgcgtttacggctacaacagcatcccgtccgacgcgccgcgctccggcatgagcatgctcaagcagccggaagagcagcgcccggtagaccagctgcgccacttgttggcggcgcgcgactaccaggaagtggtcagctacgcctttgtcgacgagcgctgggagcgggatttcgccggcaacgacaaggccattcgtctgcagaatccgatcgccagccagatgagcgtgatgcgctcgacgctgatcggcggcctggtggacaccttggccggcaatatcaatcgcaagcatccgcgcgtgcgcttgtttgaggtggcgcgagtgttcctgcgcggcgagcagggcttcgagcagccggaaaaagtggcgggcctggcctgggggccgcgcctggccgagcagtgggcggccaaggccgagcgcgtcgatttcttcgatgtgaaggccgatgtcgaggcgctgctgcatccgctcaaggcggaataccgcaaggcggcccatccggccttccatcccggccgctgcgccgaggtgctggtggatggcaagctggccggcgtgatcggcgagctgcacccgcaatgggtgcaggcttacgatctgccgagcgcgccggtgctgttcgagctggatctggcttgcgccatcgcccgcgaccgcatcaaggccaagccggtgagcaagttccagccagtgcgccgcgatttggcgctggtggtggacgagcaggtgactgtggcgcagctgatggcagccttcgcgccgaaacgcgcgcaaattgtcaccgatatcgccttgttcgatgtgtatcgtggcaaaggcgtggcggaaggcaagaagagtctggcctttagcgtgctgatgcaggacaatagccgcactctgaccgacgaggatgtggagcctgcgctgcaggcgctgctggatgccgtgtcgggactgggcgcgcagctgcgcgtttgattatgaagtgagcggggagccattgatggctgcccgccgtttgctgcttagaagtttgaggggaatgtcatgactttgacgaaggctgaactggccgatttgctgtttgaccaggtaggtctgaacaaacgcgaagccaaggacatggtcgagtcgtttttcgaagagatccggctggctctggagtcgggagattcggtgaaattgtccggtttcggcaatttccaactgcgcgacaagccgcagcgtccgggacgcaaccccaagactggggaagagattcccatcaccgcgcgtcgtgtggtaacgttccacgcaagccagaaactcaagggaatggttgagcaataccatgctaacaagcaaggctgatctgccgtcaattccatccaagcgttacttcaccatcagcgaagtcggcgagctgaccggtgtgaagccgcatgtattgagatattgggagcaggaattttcccagctgcgtcaggtgaagcggcgcggcaatcgccgttattaccagcatcatgaggttttgctggtaaggcgcatccgcgccttgctttacgacgacggtttcaccatacagggcgcgcgccagcgcttgggcatgggggaagtttccgagcgtccgatcacggcgcaggaagtgcgcgccgaattggaatccatcctgaattggctggattcgggtattggcaagccataataaatcggttagaatacgtttctcttgagtcggggtgtagcgcagcctggtagcgcacctgcatggggtgcagggggtcggaagttcgaatcttctcaccccgaccaaactaaatctttagttatcaagaaattagctctgcttcggcagggcttttttattgcccccgttctgataatgtggggattttgtggggttgtggcatcaggcggttttccttcttagcatggtgggggagacaagctgtcgttgatttgtttctcttaccctttctgccattgcgatcaggtgcccgatttcgggggcagagtagtgcgtcgtaacgctcttgctctggtggcctagtaagacttgtctatcttcaaatggtacgcctgcgacccttagccggtgtccgaaagtgtgtttcagatcatgtacccggatcgcagcaaagccgggattcgcttttcgccaatattgcttggtgaactcttctgcggctcttttccgtgcttttctccaagcgtgtccgttcatcctctcgatgttatcattttctcctggttgtttattttcgtggaatgggaatacgtatatagggtgcgctcctctcattgaatcgatgatccctttcgcaactgtattaagcacgacaagtcgatctgttccattttttacacctgatttttcagttctgccgccaaatgatgcggggataagaaatacactggtttttagctctggtataaatatttcccattcccatcttaaatggcagacttctttttcacgacatccggtatttactttgaataatgccattcgtgccaagtgattaggaagttgtggcatcaaaagacgttgctcttcccagctcatggggtatggatcgcgcttttcttttttttcatctagctttgatattgatggtgcagtctccagccaagtcataccaaattcgtcacgccatttttttgaggctagattcaatattcgaattactagttcaattgcgatattgattgttctgtttttaacaccttttccattttgaaattttaatctcccattctttctgtcattcttaaatttttccaaagtcccatcatgtattttgtctaatgttaagtcgccaatgtaagggtcaaggaattttaagtgcatggcaacatctcctatgctaggcatgtcttgattgtctaataaatacttggctgcagcttgcctccaatgtcgtttaggccgtaccccatatattgtagcttggcgaatttgatctagtttatgtattaaaaacttctccgcctcttcccggtcgtcagtgccagtgctttctcgaagtcgtccataccctttgatctgtttatcaatgtgccagatattatttcgcagagtaagtccggagattgtttttcttgccatgatcttttgtcttgtttgatttttatttgattttgttgatgactggtaatgttatctgtgctgtggttttccccgttaatttttttcctttttaaatcatctatccatgagtcaagatctattctgtcgtaatggaaaatttcgacagggctgtttttgcttctaggctcaaaaatgggaatttttggaacatgaggcatgactattttacggaatgttttgtcacacattccaacgtatgcggcagcatctacttgtttcattaatctcggtgtaattgtgattctgcttgtcattttactgtcagctattctaaactcttgatttccgcgatgcaggtgagtaggcgcttgttgaatagtgctgtgaaagtagcccgcgatggcgggctgttcgtcacattgagtttgaaacgttgcgagaaatgctgagcatagtgtcacaaatgactagcacggcccatggctcactgtggatataaatatctcctgttgttgctgagtaattcattggaaggtttcgttttgtggctaatgcctttgccacatcaggacgaaccccccttgttatggcggttattcgaacatgtgggccggcatttgtctgtagatgtgcatccatatgttcgatattggtatgaggttggccttgaatttcaagaagtagctcttttatcaaggcgaaatgccgtagaatttcaggtattgacttttccagatttcgtgcttgctgcagaatgtcgtcttgaattttcattaaatgtattccgaatgataagtgcagctaatcgatgactatcgctctatttcttccagtacatagaggtcttcccattcctgctatgctggcgctgtacgtgcaatgcaccaatggccatcaacttggcgatatcacgtcttgtctggtcggcatgctcgtttgtggtttgtgcgtgcagctggggaaaggtatatctctggcgcgaatccatggcgtcaaaaagcatcagctgcctttgagtcattttgacgcgtagtggattggtgaagccgcaggccaacaattgcgacatcattccctgcagcgggaggatgctatgagatcgggccatcatgcggccagttcttccggcagtccttgcgtcaggattggcttaatctgctgcagatagtcagcccatatcatttgcagccggtgcttgggcatgattccccattccgggcttgttagagcttcggcaaaggtctggcctttgatgctcagttctgcgatatcgcggccggccagatcggcattcgggcggtgcagcgtgacaatgccggcgatgcgctcacggttttcgtgatagacgctggagtcccggaatctgcggccgtttcgttctaccggaccaaaatgttcgttttcccaaacgataataggggctgacgtgctgtctagtagtgccgttagcccgtctatggtgtcgtccatcgcctggccgccgacaagtacggtatgaataaatacgcggcggcctgccgcattaagtacgtcaatagcgcctgtttctgcgaggtagcccgtagcgggaatgaatgatgtggcgccgttgtcgatgactgcggggccgtcatgctcaagtaaccactcaaccatggtgtcaaactggcggctgttgatttggttatcctggttcaggatatccagccctcgcgcttgcaaggcagggaaatgcatcagggttttgttgacgggatcggtatcgactcccagcggacgaatgccaaaaatggcccaaatagcttgggcgagaaggcttgtgatgtgcgacttgcctacgccgcccttgccttgaagcgtgatgtgagtgtcgttgtatgtcatgggttcaccattttgtttttccgtctctgaatttcccgtagtcaaagcgacctgatcggattgactgaggcgtggtcttggcggccggcgtggctgtgatgggcatattggccgcattggccggggtgttttgggttgcttgggcatggggtgctttcttgccttcctcgcggcggcgttcacgatagagcgcgttccggaattcaacgtggctcatgtgcaggccatcggccgccagtgcctcgatgatttgggcgtgcctgactccgcgttctattgccgcattgatttgtggcaggaggttgcggaatcgtgccgctttgctctcgcctgttcctgctagagccgcaagcaactggttggcgtctggtttgctcatgggggctaacgaatggctcacatcccgctaacgggggcgctcacaacgcgctaacaaatcgctaacggatggtgatgcgtgctaacggaagtgagcgtaaaaaaacggctggttaatcccagccgttggcggtgtcggcgcgcaggtagatccgttctgcgcggtcgttgattcgttgttttgtgcggttcttgcgggtggctatttctgtcggtaggcccggaggagccaagacgcgcaacaactgttcgcgtcgatgcatctgccgcacgatgtaatggcgtaggctcattccatttcgtcaatcgcttgcgatagctctgcaatggcttcattgagccaagagagcgaggaatccagattgtcggccatggcttccagcgattggccgtgagcggatcgcaattggttttccggcatgtcgctgatggccttgagggcctcgttgagtttggcttgcagctgctgttgcagcggctcaagcctttgcttgaaagcttctagtgatgacttgtcctagtggtgcatttttagttctccttgggtgtatccggtaatgtcctgcatgcagggcattaccaattacaggcttgcccgcgatggcggatcagagttcgcggatgctgttgatcatgctggccaccacggtgcaagccaggaattaccgcgtcgaaatgagagcggtgtctttgcgttttgttaaagagcggtgagtcaacggaatgaactttagtaaaacactaaagctatgtcaatagtgaaacactaaatttttagtgcgagacgaaacatctgctagtgagacgtggtggggagggagctatcagaatggcaatgtgctaggattagcagttttttcgtagaggtaagatgtatggaactatttgttcttattgcgggttttgtgttggcatatctggctgctaagaaccgtggccgttcagcgtggtggtggctgctggggtgggtgggtgttgtgtttgtattggtattgccatcgctcaagacagacccggaagcgccgcatcctgacactcatgttcgctgccctgagtgtcgtgagctggtgaggatggatgctaggaagtgcaagcattgcggaaatggtttgaggccaatgcaataattttgaagttaagtgcatcagacatagtgctctctcgtgtactcttatgttcggctttgtctaaaagccaaatgtttgaatccaagggttgcatcgttgtaaaatggggcatcgatttgggtttcttgcaaaccagtatttttgcgattcaaatatcattgctcggttaattaatccagcccccataattgtaagctcgcaattgtctagccctgcaataaggcaggtactaggtgatatgggcataatggcttgatttatagatgcatcaggaactataaattcaactcctatgggggattttattatcccccatttcaatttttccgcgcctaatgttagctcaatatccatcgctctttgtatgttgatgcctgagaatactctgcctgcaattgttccattcgattgaatgtaaactatcccctttttttctagtacctcctttgagtcaattgatagctccctttcgggagttactaagttgattttgacatctgctattggattgctcgctagcttacatctatatttccatagtaggtacatgtgagtaactgttaattgatcttcagtgcacatagctcgaataaggcgggagtttattttatcagcaaggttctgaaagtttgattctatatctttgctgactactgtttcggtgcgatggtcccaggctctgtttgcacagaataatgaattatttggcttaagatcaataaaaatatctttagtgtttaatttgactttgacggcttgattttcatggcaaaatcgctcaatgctacgcaatggcaacgtgtgctgttttattgtgagttggtggggattggtccggcgggggggggtatcaattgtcatttgctgttccgattatttagtgtttgcgctatttattgtagggcctgttcgtataatttaagccggctataattgcaagccttgctgaatggtttcatcttgctgagtgttgctgattattgcattgcttataattctgagaaacgcatcttttgaagaggttgcctcatcgagtaaacttcgtttgtatagtgagtaatagagtgcaacagaataggcttggcagttaatagagcgttcagggttaaattcaatgtcagtaaatgcagagtattctagaagcgactcagcaatatcagtcctttttttaagtgcattgatgtaaagccaatcatagaatgcagttaaaggctcaagctcccattcgataccataaaacctgaaccctgttagccggccagatgtacgtagacgttcatctttttttgcctctcgggacgttttgaaaaagatatcggtgtatgggccgccttgttcaaatactttgcttccttgaaatgcacattcaacactgaacgtatggttgtgtttgattgtggtgaaggttaaattaaatgcacttagggattctccaagtggagtgagtgatttgctggaaatttctaatattttactaaggctatgtttattgcaagcagctttatgtaaggagttaatggatttttgcttttgcgatactgccaagccaggaaaccattcgaaatcaataaaatcagtttttacaaagctttcacctgtcaaggttgggatgaatatcggtctttttgccatgattgagcttaccttacatatgaacgagatgcgaaaaaacttttcccagggttacaaactattacttccttaccttctagtaaatgctgatattgacttttgatgttgtggttatcaaatccgacgccaaatataagttctggttcaatagtttcaaatactaaaacttctgcttgaacatctgttgggtcataaggttttaatctttgatctctttcctcacctattttgtcaaacatgcccccaaaagcctctggggtttttaagtgatttatatcttgctgtgctatttgtgcagtagctgcattatgtttgcaaaaggcgcagtcctttgtccataatactgatctttttattcctaatacaacccagcctacatcaggattgttttgcctgtatttgaaaaacatacttgagttggggaaggagatggaaacagatgttgcatcgagatgcccgtctaaacgtagctcgtcatttatagcaggatttatttctaataattctgcttgattaattgagagcaatccatttgtcaatattgattctaaattagtaacgcgagtgaagtgtattaaatatgggatttcaatatattctgcatatgatttaatgattgcgctagtcatgataaaccttgtagggtgagtttaaaatggacttttatatgggaggttgaagttgattgtcattcgtatgaaaataagagtcatttgtgatgaaaaatgacaattaacttgaagttagcattgcattttgaagcagtcaatgagagtttgattaatgttgaagttagtttcatggtggtaaacgacgaacggaaagcagagcattgaaaggggagaggcaggttaacgttgtacgaacgtctatctataatttcaggtgtatgtattgaaggggtggtgattgagggatgttggtatgtcacctgaaatcttgaggatggtccgggaagtgccttctttggccatggcacagatggtgccgttgcagcgaggattgttggcattagaggatgaggatgacgttagggccttcctgatgggagttcagctttgtctgcctggacagcctccaatcttgttggcgcaagtgtcgggaaacaaaggattgtggtcccgtcctttttcggtctccctgggctggtcagatgcctggctagaactctatggttcgcaaacattccacgaggtagacccggttttcaatgggcctgtcggcgcgccaatcatctggtctgagttgctgctgaggcgccgttcaacggatggtaggaagatgaccagctttcggttggcttgtaagcgccatggcatgacgcatgggctttcgtatattgctgaaagaggggagaaccgagtaatcgtttcggtagtgggagaggccgcagaatatgactactatgcccgccagctgttgaccatgttgttgccatcactagcggacatggcggttcgtgtgcttactcgcaatgcacgaatggctaattttaccccgcgtgaacgtcagatttttgactgcttaacaacacaagggctgacgcaggtggagattgccgaccgccttggtttggggttgagtacggtgaaagtacatcttaagaacatgcgagaagcccatggggcaagaacattggcgcatttggtgcatctacttcggacagaagacgcagcatgatagaggacgaacctaggtgaaattacttatatagacgaacgtctaatacaaactgttacaagtgaaaggtatagttctgccttcacctttgtaacgcgtcaggtttggaacaaaatgactaaaaataaagataatcataaatttattgctgaagtaaggattaagctgagggaagatggcagtcttctagttgaggagtggggagatgcgccccgcatctggcatggctttactttggcagggggcttgttgtccaagctattggataggggttagctctgtaatgagtgttgaatgaaaaagcggccaagtggccgcttattttttatccaacttgtccgccagtatcctcaagaatgcggcaacactttgagttccttggtcagcaatccattctgcaaactcatcgagagtgactagctcggttgtcttgtctggaggggttgctgcaggtgctagcggggtcgcgctcgtgacgattgtcagcgtcggttgagcatgtgttgctgcgtggcatgtatccatccatccgcgcggaagatccaaattcttctcaatcttacgcgccaatgcgtcgcctacatttgcgggatgcttgtcactcagaatctggctgaggtaagcgggagacgtttgaacggtatccgcgaactggttggcggtttcgaaaccggcgatcagctcttgtagattctgtaagcgaatttgtttgttatccatgcctagatgatgcgcgactttagcgttttacgaaatgagtgtgcaactaaatttgttgcgtaaaatttagtgaaacactaaacttgcaccatgaaacttcgcaactatctcaaaaagcttgatgccgaaggccgggcacgccttgctgaagaggccggcatcaagcccatctacctgactcagatcgctggaggtgcagaaccttcccctttgctttccgcgcgactacagcgcatcaccggggggattgtgacggtctatgagttgcggccatcagatgccttggagatttggccccttgcgtctgcctgagcttccccgcgtcccgcagtccagcgtgggacgcttccgccggcatgcccggtgttttttcttctgtatgtagtagccatagattctcatgttatatgactatggcgcgcactacatccacatttaacatatttgtcatgattctagatattcacgaaaccagcccatccaagaggggtggacaggatgcaggcatcgatgcgcgcggttgacatgctgttggcgcagctggattggcaagcgcgagtcgcaaagccaggatgcaaagccaagctgaggcgccgtcacatcgatttactttagcgttcgctagagccggatcaacggaggcgagatgatgccatggcagaaagaaagcggtgatgtaatagcagatgctgcctatatcgtgatgctgcccacgaaaagggcgcagcgacgagagctaacgcggttgggacgggtacatggtgaagggcatcgcttgactgtgaagcgggccattaaagagggctggctcgcagtggaagcgaagctagcgcctttgccgattgaacatcacgaagaccctagacgggcagcgttggctgctgtgggggggaaggggggcgtatgaaagtattgttgacggaacaggagcaggcggctttgctttcctgcagcctggaagctttccggctctatttggccggactgcgtccacgcgtggacattcgaacgggtattgttggcaggggctacccgattagccgcagcgtgctcgctatacattgtcagtacgtcccgccgcgcggtagcaggcggccggcgtggatgccctcattgaagcaaatagatgctttgttggatgagctggaaagagtgggcttgatcaagcgagcagctactgttcaggagttcaaaaaattggtcttgaagctaccgcttttagtgcgtctaggtgatgaacaggacatgagcaggagtgcaggaggtgggcagcgtgatatctctgaaagtcaggcagcgcaaggctctgaaccatctttgattgctgttgatcaggatgagggcggacagtttgaggcggacatatctgagaataataataaatatatacatatcgcgcgcgaaggggagtgttgcgagcaatcaatgcgtttggcggcagctgccacacggcttggtgtgcgtgtcggtggtgccgccaatcctgcggtactggagtgggtagaggcgggtgtcacccttacgcagcttcggcaggctattgaccgaagccggggctatatcgcagcgggtaaggtgatttcggccaagtatctttcgaaagttctgtggtcgattcgagaggaggaaaaaccgtctgcagcccgttcagtaagcggtcggccgcttgagcgtaaggtgggccgaaatgatccggcttggaagagtattccagccccggaccctgaaaaggtggtgccggtttcgggtagcgtggtgggcggggatgagggggattggcttgattgatgctgtgcagtatttccctcgcgtagcgggatttcgagggcttgccaaaatatcggcacgctgccaaaagcatggagagtttgaggcggctgtattatctggagtcgagccgagatgcctacgctgtgagcttgagatagaaagagaaaagcaagtggccagtcagcagaaagccacaatggcacgctgcggcgtgccgggtaaatttcgaaatgccaaatttcgggacttattggaaatttgtcatgaacaagtggcggtattgaatgcttttaaaaaatgggtagtaaaagttggcaaggatcgaaatgctggtaatgtggtgatgatgggatttaccggcacgggaaaaacacatatggccagcgcggcggtattaaatcttattgcgcatcgtggcttgaatgtttgctatgtgacatccgatcagatgaaaacggaagtgtgtgaaacatggggaaaagcagggaggagcgaaagcattgagttgaatcgatttgcttcttattcagtattaattattgatgaagtggaattgttggatgccaatggtcatggtttgcgtgttttgaatcgggtaatagatatgcggtctgccgagggtttgcctacggtctttattagtaaccagacgcaagagcggctgtctgaaattgtcggcccgcgtgcggcaagtaggatgtatgaaaatgctttggttttgcaatgttattgggaggactttagaaagcggcattttgtaaaataaccaagccgccatgataaaataacaggctaaaagaaagcccgacggtgatcgggctagggaatttcttcgctgggtttttgagggtttggctttgattaaggaagtggacgaactgctgtggaaatggggggcttgggttgatcagcgagaagctaatggcttgggctataagatgtcgatcttgaatgaagcaatggcacaagcgggaaccgagcatccagagcgtaggggcgcgcggcagacgtttgataatgaaaagttgttgctggtggatcaggtcttatgcagaaaaatcaaggcggatacaaaggggttgattgatcgctactacagagggcgcataggcggtgtgactgctgtacaggctgtggacctaccgcgtcgccgagtgggggcggtgacggcacaatttgctgattctgcaggcgtctcttgccggacagttgagcgctggatgcataatgcgcaagtagagttccagcttgccatggcgtctgtgacgcatcgagtgcggcaagttggggtggtcggtgtggtgtgtgagttggaggcgattgctgccaatgaatgatgatcgcttgacacatcatgtcggacttgtgtaaatttaagctactcttgaaacaattgcgagtaacgaaacccgaggcaaagccctcgggttttttgctttctgcgccccggccatctggtcggggcgttcctatttgtggagccgctatgcctgtcgcaccttcccgcccttgccgctacgcgatgcagggctgtcgccagatggccgcgccgggtaacagctgctgtccggaccatgcatcccatgttcgtcgggtggcggatcagcggcggatgtcggatgaaaccgtggccaaggtccggcgctggtatcggcaacgcatctggttcgcccggcgcgatgcctgtctgaaagcggcgctctatcgctgcgccacgccgggatgcgtgaaccgcgcgaccgattgcgaccacatccggccgcatcgtggcgactggtcgctgttcatcgagtcgtccaatcatcaggcgctttgccattcctgccactcgcgcaagaccgcgcgggaagacggcgggttcggcaaccggcggcgcgaggtcggccagggggtaggggggtgaaatccttccgcccgaccgcctggccaagaccgcgtgcctaaccgcgcttttctccacgctggattttcataggggggggtctaaatccccccaacaagccccgaaaggggcttttttgttttctgtcgcgctcaactagctgaaaggctctgaaatggccggaaaagcccctttgcgagcgggttccggcgtgatgcccaaaccgcccgcctttttgacttcgaagcgtggccgcgatgtctggaaatacaccatcaacgcactggacagcgctggtctggactggacatccgcgctgctgcagatcgccttgttagcggacaaggtcgatgactggcggacgcatgtcgaggaattggaccgctacggccatcgctacgacgaggacgccaacggcggttcgctggaaaccgatgagtcccgcgccgagcggcgggcgcggggcgaggtgatgaaagacctggatgaaggcggcttgacggtgatggccgccggccaggtgcgcgccctggatcggatgttgacggcggacttattcgcctccgatccgttcgcggtgatggaccagctgggcgagggcggcgccaatttgccgaaaaaaccgccctggtcgatgaccaaggcggaagcgcgtgcctggcgcgagatacagccgctgctgcaggcgtcgggcttcgactattcgtcggcgggcatcgcgctgggcctgatctgcgcggctattgccgactggcaagcctgcaagcagtggattttggacaatcggggcaagattttcgcggcggccaaggagactggccgccggtatgaagtcagcgccagctacaaccgggcaaagatcgccaaacagatgcgcgaattgctcaaacgaaatggaatgacggtggcctcatgcgcaagaaccaaggcgctaagcaaggggcgggtgatcagcgaggacttggccgagctgctggggtacatcaacgacaggccggattgattccggcctgttacgttttacagccgtgggatcagtacggcgtggacgtgctggaaggccgcatcaaggtcggccgctatgtccggctggcggtggagcggcatttccgcgacctgcagcagcaggaagcgcgcggcctggtctggcggccagagatggccgcccatgcgctggcctttttcccgcgctactgccgccatttcgagggcgagtggtcgggccagccggtggagctagcgccatggcaagcgttctggatcgcggtcgagtttggttggtacaaccgggacggccggcgccgcttccgcaccttttatgaggaggtggcgcgcaagaacggcaagtccaccaagctggccggcctgggcctgtatctattcgccgccgacaaggaggccggcgcgcaggtctacacggcggcgacgaagctggagcaggccaaaatcacgcacgcggcggcggaaatgatggtcgccaagtcgcccgccctgcgccagctggtgcagaaccacaaaaacaagctgtggatacctggcacagcgaacaagttcgtgccgctgggcgcggacgccaaaaccctggacggcttgaacgtacatggcgcgattatcgacgaattgcacgcgcatccctcccgcgacctatgggacgtgatcgataccgggcgcggcgcgcggcgccgcagtgtgatgcacgcgattaccacggccggtttcaaccaagagggcagcatctgcctggagcagcgaaattacctgatccggattctggaaaatcagggcaaagacccggcgctggaggacgacagcttcggtggcgtgatctacacgctggacccggaggacgattggtttgacgagtcggtatggtgcaaggccaatccgaatcttggcgtttcgttgttcttggaagagttgcgcacgcaggcgcaaaaggcgcgtgtggtgccgaccgcgctattcaacttcctgaccaagcgcctgaacatctggacgcaagcggttgatagctggatttccctggacgaatgggacaagggaacagccgcggtcgatcctgagttgctgcggcatcggcgttgcttcggcggcctggacctggccagcaagacggatattgccgcttgggtgctgctgttcccgcctgagaagccgggggagccatggcaggttctgccgcgtttttttgtgccggcggacaacatgctggcgcgtgacaaaagcgacagggtttcctattcgacttgggcgcggcaaggctacatcacggccaccgccggcacgcggatcgatcaggaagtgatccgcgcccagatcctggccgatgcccggcaattcgatctgcaggccatcggctttgacgaatggaacgccggcaagttggctaccgaactgacagaagacgggctgcagttggtcgcgctgtcacagaatttccaaaatctgtccgacccgacgaaagagcttgaagccctgatcaagtcgcaagcgctggctcatggcgggcatccggtcctgcgctggatggctggcaatgtggtggtgctgcgggactccaatgacaactatcgcccgaacaagggcaagtcgagggagaagatcgacggcattgtggcattggtaatggcattgaatcgggcgctgtatcacgccccggcgggatcgttcgtttccgcctacgaagacgaggtgtgcttgtgagtaagttggactatttgacgttgctggtcggcctggccggcgtggcggcggtgacggtcggcatgtcgctgttgcatgcggcggccggttggatggtgggtggcggtttcgcgttagcctggtcgtggatgacggcgcgcagcgcgggaagggcgcgctgatgttcatgtcacagcagtttggccaatctgcggcatcgcccgatccgggctggttatccagcctgctgggcggcggcgcccggagcgcggccggggtggcggtatcgccggacaaggcgctatcgattaccacgtatcaggcatgtattaccacgctggccgagtcgctggcgcagctgccgtgcgaactgtatcgccgcaacggcgaccagcgcgagcgggtaacggatcatcctgttgcccagctgctgcgccagcccaacggctggcaaacgccgttcgagtataccgaaggcgcgcagatcgctgccgcgcatgatggcaacgcttattcctacatcgagcgcgacgaggccgggcggccggtggcgctgttgccgatggaagccggcaaggtggcggtgctgcgcggtgcggatttgatgccgtattaccgctttgacggccaagagccgatgccggcgcatcaggtccatcatgtgcggtggtttacgcgcaatggctataccggcatcagcccggtgcagctgcattgcgatagcctgggcctggcgctggcgacgcatggccacgccagcgcggtttttgcgaatgggacgcacctggccggcgtattggagcggccggcggtgatcggcggccaggatgtgaagccgctgagtgcggaacgggtgctgcagatcaaagcggcgtggaagagggagtacgccggccggggcaacgcgatgaaagtcgcgttgctgcaggagggtattaccttcaaaccgctttcgatgacgaatgccgatgcccaactgatcgacgcgcgtaagttgtctgccctggaggtggcgcagattttcaaaatgccgccacacaaagtcggtctcttggaccgggcgacaaacaacaacatcgagcatcagggcatcgagtatgtgatctattgcctgatgccctggatcaaacgccacgaacaggcccgcatgcgcgacctgttgttgccgtccgaacgtggcgagctgtacatcgaattcaatgtgtccggcctgctgcgcggcgatacgcaaagccgttatgccgcgtatgcgattgggcggcaatggggctggctgtctgccaacgacatccggcgcttggaaaacctgcagcctatccccggcggggatgtctatatgcagccgctcaatatggtggacacgcgcggggcatcactgcagggcaagcctgatgctcgcgctctggtggagattgatcgcatcctggcgtagcccgctaaatatctatttcctatcttcataatattttcccgagtgttatagttattgtagggtggttgtcgtcttattccttcgagctggcgaattcgatatgctggtacgttggtaatagtcattttttaatttctctctaggaagtgggagcaaaggcaagatgatgggaaaacacgagccagtgtacaatatatacacatattttgaagggggagagttgcgagcgataggtatcaagccatattatcggaaaggcggggatcagaaaaaactagcctttttgcgcgagcgtgccacgctggacttttcatctgtacaacgtgtgccgttagtgccgccgatgcctcaagaggaatactttgcaagacagcgaataggaaatactcttgagatttttgaaccacttcttgcttcagttggagcggggcggacgccgttattttgtattactcctattgtggatggtgttccaaagatcgatatgagcgtaccgatggggcctctagatatgtcaggtgtgcctaatgatgcagtgggtggcggggagatggatgattatctgttcaaatatttagataaagaggccggcacgtttgatatgccggctctaattaatgacgattactttaaagcaatacgattgctttttaataatcggcattatgtgtcatgcttaaaattattaatgtcgtttctggataccatcgcttatgttgaatttggcgatcgacctccgcgcagtacgcccgtatttatagattggctgcgtgcattttccgcccctgggttggctggggcaacgccagaagagttatgggagtttcgaaatagtcttttgcatatgtcgaatctagaatcgcgtaaggtttctgagggaagtgttgcccagttaatgccttatgtcggaagtcaaaattgcttgcctagtgtggacccaaagagaaagcacattagcttcaaagatttgattgaagatgtgggtgatgcagttgagaactggattaagacatataataaagatccaaagaaaatggttacgtttatacaacgctatgatctagtggtatctgatgatcgctgggcgactgcgattgtgaaatctgctgaggggtaattaattatttatttaatttctatcattaagtttgatttggtgacagattcattattggtattgataggacttcgcccgtttttgtaaccagcccgccgcaaggcgggtttttttatgcgggaaggtaaggcatgcagccaattgactcggaactggcgcgggaaaccggcgagcaaatcatcgaggcggtgagggagggccgctgcgacgtgatggattgggaaaacccggtcagcgtctgggggccgaatgaatgagctggctcttttcgcgggggctggtggcggaatactcggtggccacctgttgggatggcgcaccgtctgcgccgttgagcgtgatgcctacgccgcacaagttttggcgcaacgacaaaccgatggatgcctcgcgcctttcccaatttggtctgacgtgtgcagttttgacggaagaccgtggtcgggacttgttgacgtggtatcgggcggcttcccttgccaggacatcagcgcggcaggacggggcgccggcatcgagggcgagcggtcgggactatgggccgaaatggcaagaattatcggtgaagtacagccccgattcgtcttgctggaaaactcacctttgcttgtgggccgaggacttgccctggtcgtcggtgatcttgccgaaatggggttcgatgcggaatgggcttgtctatcagcatccgaccttggcgcgccccataagcgggatcggatctggctcgccgctgtggcaaaccgtggtcgcggacgatgcgatagagcgggcggcgggcaagtggaacagccggggagagccgaggctgagcgcgcaagtgaagctgtggccgacgccgaccgcctgcgccagcaaggggacgtcgcccggctcgctgatccggaagaccggcgccagccgagaaagggaccggctagaccatgcggtgatggcttcggaccatggccaactgaacccggaatgggtcgagtggttgatggggtggcccatcgggtggaccggattaaagcccttggcaatggacaagttccgcgcgtggcagcggcagcatgggcctgcctggggccaaaagccgcctagccctacctgcgaaaagagccttgcagcccgcaaggatcagaaagagagagacaacacatgaacgtttccaactacacgccgccggaggccgtgatcggcggccagggcggcagtctgctggcggccgtgctgatcggcgcattgtcccgccatccggtggcggcctcgttgccacagctggccacgccatcggcaaaggctggccagtgagggggcaattcctgctgtcgcagctgttcaatcagccgcacatggtattgccggacgtactgcatgaggcggtggcctgggccggagagcgggccggcatcgagttgcgccagctgggcgtccacgtcgccgccgcgctgcagcccgcagcctggcgcgatgacggcggccgggcgtcgatggccaacctggcggaacagcggatgcagtccgcccagcaaacgggcctgctggtgatcccggtgcaagggctgttggtggcgcgcgaagcgaacgtcaatctgtgcgccacgcaaaccagctatgaaggcatccgcagccagatacaagccgggctgaatgatccgcgtgttagcgccatggtgctggagctggacagccctggaggcgctgtcgtcggctgtttcgagctggtggccgacatcgaggcggccaaggcggtcaagccgattcacgccctggtgcatttcaatgcgttttccgccgcctacgccatcgcctgcgcctgcagtgatatcacgctgtccgaatcgtcgggggtggggtccatcggggtgatcatgaagcatgccgacttcagccagcagctggccagctctggcgtagctgtcaccacgttttaccggggtgcgcgcaagaacgacatggccagcgattcgccgttgtcagacgacgcccgcgcggcggtcgaaaagcgcatggacgcctattacgacaagttcaccggagtggtggcgagcaaccgcggcctttccgtcgctgcggtcaaggcgaccgatgccgggctgttcttcggcgctgaggcggtgcttgtcggcttggccgatcgggtggaaagccagcaattggcaatcaaccggctggccgccgaggtggccgcgagccggtcgccgccgcttgcgccttcccggcgcgcgaccgccgccgcgatggcgatggccgcccagctgtaacccaacgcaaacccaacataccgcgccttcgggcgcgtttttcatttcagccgcttcccgtggctttttttacgtctggagtctggatgtccgtagtgcttgagttgaaaaaacgccgtgccgatctgtccgccgctgtgaaccagctggccgccctggaggcgaccggcgccgcgctgaacgctgaacaggtggccagcatcgacgcgatgcaaaaagagtttgacgacatcggggccaagatcgcccgcgctgaagccgccgagcgcatgacagccgccacggcgcagccggtggacagctcgcaaggcccgcgcgctggcgcggcgccgatccacgcgacgccggccgcgccgaccgtgaagggcggtggcatggcgcgcatggcggccgcgttgattgaggcgcaaggcaattaccgtcaggccgccaacatcgcggatgagcgcggctatgggcaggaagtggcggcggcactgaataccggttcgccatctgccggcggcgtgctggtgccggccaatatggcgcgcgaagtgattgaactgctgcgcccgaaaaccgtggtgcgcaagttgggtgcgcgctcgctgccgctgaacaacggcaatttgacgattccgcgcctgcgaggcggtgcgacggtcggctatataggttccgacagcgacgcacccgtaaccggcgcgcagttcgatgacttgaagctgtccagcaagaaaatggcggcgctggtgccgatcagcaatgacttgctgagcaatgccggcatcagcccgaacgtggatcagctgattgtcgatgatctgacatcgtcggtgggcgcgcgcgaggacaaggcgtttttgcgcgacgacggcagcggcaatctgcccaagggtctgcgccattgggcgctggctaatagcgtgtttaccgcgccggatttgggggccatcgatgcgaccgcgctgcaggtgctggaaaacttcctgaacaagctgattctggcgctggagggggtagacgccaacatgacaatgcccggctgggtaatgtcgccgcgtaccttccgttttctggaaggcttgaaggacatgaagggtagcaaggtctatccggaactggccggcaaaaccctgaaaggctacccagtgggggtaacgacgcaagtcccgaacaacctgggcaaagacggtgacgagtccgagctgtacttcgcggactttggggattgcttcatcggcgaagaccagtctctggtaatcgacttctcgaaagaggctacctacaaggataccgatggccagatggtaagcgctttccagcgcgaccagacgctgatccgcgtgatcgccaagcacgattttggtccgcgtcaccaagagtcgattgcggtcggcgtcggcatcaagtggggcaagtaagcacagttcaaggctcgctacggcgggcctttttgcatttgaagggtacagcatgattgcagtgaagttcgtgaagccgtatggcatttatacgccgggcgacatcgctggtttcgaagggcaagccagggtcgatgaactgattgcgcgaggcatggccgccttggatgacgaggacggcgaaggcgagccggcgccgggtgaaaccaagccggtggccaagagcaaagccaaggcgcaaccgggcggcgtgtaatggccgccgaggtgatccggcgcagcccggcggcggtgctgacgctggatgaggtacgggagcagtgccggattgatgccgatttgaccgacgatgacatgctgttgcagatgatcgagcgcgcggccgtggccagcgccgaggcccggatcggtgggccgctgttgctggccgaatgtcgcgaaacgctggatgcctggccgggcctgccctggttgtatctggatatcgcgggcgggcgcgaggtggtcgccatcgaggcggtgcagcaagggcagcgccggccgctgccgctggacgccttccacatcgagcgcggcgagcggcgtttgtgtatcaagccgctgaaaggctggccggcggtggacccgttgccgggagcgattgccattgtctaccgcgccggcttcgcagaggccgggcaagacgtgccggaggatgtgcggcagtggctgcgtttccgtgtggccacgttatacgcctaccgtgaggaagtcagcgccggcagtgtggtggcgttgcctgacagcttggtggacagcctgattgcccattaccggccgacggaaagcccgctatgaacgccagcatgctgaataaccgcatccggttaagtcagcccatcaagtcgcgccagccgtccggcgcggtgcgggaagcctggagcgagccgaagccggtacacgccaaagtggactacctggccgcgcgaacctatacggcggtgctggccgagcaaaccggctgcagcgtgcgcgccaccattcggcgccggccggtggcgcaagggtggcgggcttgggtggatggtctgccgttgaaggtcaaaaccatcgagccgcacaaggaccggggctatctggtgctgatgctgaagaccgacgatggcaacggttgaggtgcatggcctggatctggtgatgcgccatctggacgcggtgccacgcaacctgcagcgcaagattttacggcgcgggttgaggaagggagccgccctggtgcgcgatgaggcccgccgccgggtgcggcgccgatccggcgtgctggccaagtccatcacggtcgccagttcgcgcggcagcggccagcgcggcgcggtcgcctacaaagtcggcttgcggtcgcgcgcctggtacggccgttatctggaatacggtcacgtcaaacgagggagggggaaaaagatcgcaggcggggaacgaagacgagccgcgacgcgggaagccttgaaaggggcggggcaatttgtcccgccctatccatttatgcggcccgccgccgacaagttgccagctgccttgggcgtggtggcggacgaggtgtgcggcgcgctgatcagcggggagttgtcgagttgataggggcggtactggtggaactactggccgcgccggaagtggctgccctggtcggggatcgggtgtacccggtgcatttgccggacgagccggttttgccggcgattgcctatcaggtgttggatgagaagcggcagcagatcgcgcgccggccatctggccgcgtgcgcagcctggtgcaattgtccatcgtcgcgccggattatgatgccgcctactcggtggcatgggtgatccggcggcgcctggagcgctggcgtggtcaggccggcggggtactggtttacgatacattggaagaggcgttgcaagacgttggggatggtacgccgcatgtggtggcgatgacttggcgcattcactggaaagagcaatgagcaagattgaagccctgatgcgggcaatggaagaggcattgaagagcgcgacgccggcagcggatcgcgtcagccgcgatgtcgagaagggttacagctttggcgagtttcccgcaatcgtgctgcatcagctgcgcgatgcgccgctgtccggcagcccggttggttacgagtaccggcagttgtcggtggagttggaaattcaggcggatggcgatgagccgcacgctgcttgcgatggcgtgttggaggccgcgcatttggccctgcatgaaatgctaacgggcgtacaagatctgcagcaaggggtaatcgattgggactatgacgaggaaaaccctgccctaggcgtttgccgtgtgcagtacttgctgacttatcggcggagagaggaggagttgtaagcagaaagtgagctgttgagatgtattcttaacatcttaacttgacgtattgtttctagtgtcgccaacaaaacattaggctatcacttgtaaatcgatgatctgtcatgtgcgtcattgtgaaatgatataatttctgccagcaggtcttaaagatacagagtaaaatcattgtgagtttttcatgcgcattttctttgtcgcgagtaatgatttggacggggtgaggtctttcccattcgttagcgagagggtgatgttgcacctttctattgtgtcgtgttaaatgtttcgcatggcaataggtctaagtttgatttttaataatgaaagcttgcaatgattgattcggatagtctgggaaataaaggcgaaaagcggtttggtgaactttgtgccgatgcaggattgttttgtaatgattcttctgatcgtgacagagcgggatgggattttatagttaactttccagaaagcgaggaacgtaaagagtcgttggataatcgaattgcccctctttcttgctatgtgcaagttaaaactatttggagtaaagggggggaggtaaggttgaaattaaatatggctgaaaggcttgcgaaagagcctattccatcatttatattaatattcaaggtggatgtggatttgcagttttcaaatgcatatcttattcacatttatgatgcaagattggcagctattttgaaaaggctgcgccatgagcacgctaagtgcgatggaaagtcattgaataagaaagttattaaattttctcctttggaagaggagactatccctatttctgggagcgggttgcgtgaggcaattattcgatgtgtaggtggggacatcgatcgatatgtggagagtaaaaagcaacagcggctatctgttggttatgatgagcggcctgagtcaataaaagtaactttccagggtttgagtgatgcggaacttcttgatgtgtttcttggcataagaaaagatgtgccagttttgaattttgaatctgcagagactaggtttggcattgcaattaaaaatataccatctgatagcggtcggataacaatagagccgaattcattaggtaaatgtaaggttttagctcgcccgcctaatcgtatgggggggatggcaattctgtttggcgatttctacatgactatgaaagtggggagttgtcagaaagcaattgtaagaagtaatatattcactattgaaataactgacctagatgctagttgtcatgttaaatttgaatattctacttatgggaaaatgtgtgatctatcggagtgggcgaattttctgcagctaatcctgttgctgaatagagatgatgtaatggtcgagatacatccgccaaaatcaaaaaaaccacttgaaattaaatcttcttattttgatttgaagcctagtggggataagcttgatgcagtcatgcatgatatcttcattgtaaggagcttggagagtatattttctttcatcggcttgagttcacgaccattgatcaagctagaagatattattggaagtgcaaattcaattgcaatggtggcggcgctgatggacaatgtaaatccaaatcttaatttggattgtgattattttggtgctgtcaaagatattgataaagaaattattgttgcatcaagattttatgttggtgagattttaatggcgtattatgctgttgttcttggtgtgagtgttgattcggtggagggagaggttggttatgatgtgtttgagttcaagagcgttgtaattttagacaatgtagaggaggcgtttgaagagttcttgaaaagcattcgatgtcaagaaaatattgatcaagtagtgctaatttaataccttctctattccgttactttttagccaaggcctgcagatgcgggctttttttgtgcctgggagaaatgatggcattgaacagtaagcgggtggcgattatcgccaagccggaaagcaaggaaggcgtggacgcggtgccgactggcgcggcgaatgcgattctggtggccagccccaaggtgacgccgttggatagcgaccgtgcggaacgcaatgtggtgcggccctatttcggcaatgcggagtcggttgttaccggcgtgcgcatgaaagcggaattcgaggtcgagttggcaggggccggcgtggcgggcgcggtcccggcctggggcgtgctgctgaggggctgcgggtttgcggaaactgtcgccaaggacgccagcgcgagctatgcgccgatttcgggcggacatgagtcgctgaccctctattacaacctggacggcgtgcagcataagctgttgggcgcccgtgggacggtatcgctggatctgcaaaacaaggcgttcccgaaaatgaaattcgtgtttaccggcgtgcatggcggcattgtcgatgcgcccgcgccggcgctgaagctgacgccgtttcagacgccgatgccgtttgacgcggcgaacgtggccagcttctcgctgtatggctatagcccggcagtgcagagcctgtcgctggacatggccaatgaggtcaagcatcgcagcctgccgggcggtgtggaaagcgtgctgattaccggccgcaagccatctggcagcgtgcagatcgaatcgacgcgggtggcggaaaaagactggtttgcgctggcgcgcaccgcagagcgcggcgcgctcgccctggtgcatggcaagacggccggcaacatcatccagattgacgccacggtcagcatcggcagcgccgactacggcgacagcgacaacatcagcatgaccacgctgccgctcgccctgttgcctaccaacggcgacgacgaaatcaaaatcacggttcgataaggaaacccatgttcaagatcgccaatagcggcacggtgcgcgtgccggctgaaatcctgacccgcaccgagtccggcgcggaaaacaaagtctccatccagttgacgggccgcctgctgtcacagcctggctgggatgccctgttcgccaaatacgcaggcgaggccggcgcgggcgagctgtccgaggtctaccgccaaaacgcgcgcctttacgccgaggtgttcacggcatgggatggggtagccgatacagacggccaggtgctgccgctgtcgcaggcggcgcttgaggcggccttgctgtcggtggacgggccgcaggtcaatgccgcgctgcaacaggccgtccatgaactgcgcttcggtgccgtccgaaaaaactgattgaggcggtgcgctggcagtttggcgagcgcgccgccacccggtcggaggatcggcaagcgctgctggcggccggcgtgccgctggaacaagcggacgcgatgttgccggcccggtgcgacgtggaggcgttcgcattgctgcctgacgcgctgccggcctggcgcgtgtggcaggcgatgcagacgcaatggcgggtcggcccggcggggccgtatgggctggactatgcggcgctgcctgtggtggaaaggcgggtcggcctgccggcggcgcagcgggcggaggtgttcgattgcctgcaagagatggaacaagaggcgctgcgcttgatggcgaagaaaggggcgtgacgtggctgcgcaaaatgtaggttcgctggtaatcaatctggaagcgcgagtcgcccagctgcaaggcgacatggcggcgaccaagcgagttgtcagcgatgcaatggataccgtggagcgcgacgccaagcgcggggccaaggcgctggaagacgcggccggcagcgccggcctgctggccagggctggggcggcgattgcgggcggctttgcgctatccgcagtgaaagatggcgtggtgtcggtggcggcggcgctgaaccaagcgcagattgccagcgagcggctgcaaaagtcgctgttctatgccaacggtggtgacgtgcgggcgattgcgtcggatatcgaatggctgaggcggcaggcatccgggctgggcctggacttcgcgcaagcgtccgcgtcctatgcgcagtttgccggcgcggtgaaaggcacgccgcttgcgccgtatgcgcgccaggtgttcgactcgctgtctacggccgccagcgcattcggcttgtcggcggagacggcgcagggcgcgatgctcgccctggtgcaaatgtcggctaagggtgtcgtgtccgccgaagagttccggggccagttggccgagcatctgccggtggcgacgcaggcggcggcgcgcgccctgggcgtgacgacaggtgagttcagcaagatgctggaaagcggccagttgctggccgccgacttcctgcccaagttcgccgccgagctgaagcgcatgagcgcggacgcggcggcgttcggcggcgagacgcaaaaggccagcgccaatttcgtcaactcgtgggaggcgatgaaaaccgaggtggcgcaatcgggcattgcctctttcattgccggccagctggccatcctgacggatgcatttgacgacgtgtccgagtcgatgcggcgggcgcgcaaagagggttcaggattctgggggcagacgatggccggcggcggcgcggtgatgcgctttctgaatccggtgaatgcgctgcactacgacgcgcaaagcgacaacgcccgaatggcccagctgaaagagcgtatcaaggaggggcaggcgggtctgtatgagtattcgttttcgcagacgttggcgcaaaagcaagcgggcctggctgcgatgcggtcggagctggccgagttggagaaacgcgccaaggcggcgacaaccgatgccgccgccggggccaaggctgcggaagccaaggcggcggcgcgcaaggatgccgaggcccgcgcgaagaagtacgcggacgacgattcccgcctgaatgaccgtgaggagttcgacaagaaggtcaggaaggaagaggaggcgttcaaaggggccgtggtcggtttggagaaaggcagcgcggcctatctggcggcggagcgcgcgcatcaaactgcggtgagcaagctgcgcgacgacttcgacaagaagcaagccgccgagcgcaagcgggccggcgcgcagggccggcgcgaggatgccgctatcgacgcgatgcagcgcgaaatcatgggtgtggaaaagctgtcagccgtcgagcgcgcgcgctatgaaattgcggaaggcaagtatgccggctggagcgccgccagccaggcgcgcttgctggcgctggcggccgagctggacgccacccgccaagtgcgcgcggaaaacaagaagttcctggatgagctaaaccgcgatgtcgagcagtacgagacgcatcagcgcgatgtggccaggcgcttgcgcggcggcgagtacgacaacgcggcacagcgcctgcagagcgagcatcgggagcggtcgctagatatccagtacaacgctggtttatcggaccaagaaaagcagcagtatggccaacaggaagaccgccgtaacgaaagagcggtggacgccctgcgcagcagcgagcgccagggcatcggcctgcagtccgaagaacagcaactgcgcgaccagtacgaccgtcgccaccagttgatcatggacgccaccacgctgagcgaaaccgaacgggccgactacatccgccgcaatcaagagcagttgaacctggatttgatgaacatggagcgcaaccgcgcgtccgcgatgctgtcgagttccagccagctgtttgacggactggccggcctggcggccaccttcaagggcaaaaacagcggcatctacaaggccatgttcgccatgagcaaggcattcgccattgccgattccgtcatcaagattcagcaggccgtggcgacggccgccgcatctgcgccctggccggcgaacatcggcgcgatgtcgtcggtggtgtcggcaacggccggcctggtgtccacgatagccagcacgaacttgtcgggcatggcgcatgacggcatcgacaatgtgccgcgtgaagggacgtggttgctggacaagggcgagcgcgtggtggatcgccggacaaacggtgatctgaaagactttctgacccgcgtcaatgccgcacagagcgcgcccgccacgccggcccagccggtcaaggtggtggtcaacaacctggctccgggaacggcggccaggaccgaggagcgtcaaggcgcgggcggcgagcgtgaaattctggtgctggtggagcgggtgatagacaacaagctggcgcggtcgatgcgaccggacggtgacatttacaactttgtgagggggtaggcatggcggcggaaaccttcggctggacgccgctgtttggcggttcatcgtcgatccgggcgcgagtgcgggaggccaagttcggtgatggctatgtgcagcgcgtgccgggcggcatcaataccatgccgcgcagccgcaagctgtcgtttgcgggggatgcggcgatgtgcgacgccatcgaggcgtttctcatgcgccatgccggcgcgcgctggttctggttcgcttatccgggcgcggcgcgctgcaaagtgcgttgcgaggaatgggaccgttcctatctggccgccggggatgaggtggtgagcgcggcatttgaacaggtatttgatccgggggagtgatgggagagattcacgcagaaaaacagcgcctggtgcctgatgccctggtgcagctgttcgagatacggccgccggccggcgagacaatgcagccgctgcgctttaccaccagcggcaacggccaggcagtgacgtttcaggggctgacctatgagccgtgggccatcgaggccaccggctttgaaagcagcaacaaaggcgcgccacggccgcggctgtcggtcagcaatattggcatgctgccggatggcagaccgatgcgcggcatcttcacggcgctggtgatgcagcatcaagggttggtcggctgggaggtggtccggcggctgacgcacgccaagttctgcgctggcggcgagctggcggccttcccggaaatgcacccggaagaaatctggctgattaaccggcgcgaggccgacaacggcgatgtgctgacatttgagctgcgcagccggctggacctggccggcaagcgcgcgccgggcgtgctggtgacgcgctattgcccggcgcatgtggtctaccgtggtccgcattgcggctatcagggcgaagcgatgttcgatgctaacgacaggccggtgatggacaagcggctggacaagtgcggcaagcggctaagcagctgccgctgtcgggccaatctggccaactacggcggctgccctgggatgagacgatataactaatatttcgccatagctgggagtgtgtttctttggtttttctatgttgattggcgttttgttgcaagggtggtagtgattgttgcgaagcacaatgacgttgcagtaatatgacaaatggcatgaattaaagatattaacaagcatgccgaatgtctaattctgtgatggagaagtgtagtgggaatgatgattgatgctgcgcgcaataattttagtggcaacttactggcaggtaatggcacaggtgccgctgctggtggggtgcaaggtactcagcaaggaagtgcggttcaaaaccagagccaaaatgctggttcgacagcgactccctctgtggtagtgtcgctaagcgggatgaagccaattgaggagcatacgtatgctcctccaagccctaccgttgctcaaacagggagtacaggcagcggagacagtcaagcgccggttgcgcgtcacaatcctgctttgactccggccgtattggctgcgcttgcaggcatgaagccaattgtcgaatatgctcgccctccacaaggttctactcctgcggcgagccctgcatccactccacaagctggcgcggctttgactcctgctgccattgcggcggccaatggggccaagccaactgctgacttggtttctacggttacccatgcggttagttctgcagtggataccgttatcgataagggatatgtttgtgctggcggtgcctatggggtggcagtaggtgtctgtgctgatacgcatgggactgtcgtggtacaggtcggggccggaactcagggggtttcactaggggctggtttggctttgaatggtgatacggcaagccatctcgctggatggtctgttactgcgattgccccaaattatactgggatcacttattctcctggaaatcccggcataacatctgttaatgtcggcatgccgggagcgagtgtaacttacgggtttccaatagaatcgagcaaaccgtatgagtttcatgtcgcaccgccaatgaattccaatccgaatcagtgtacaaaatcagattatgagcacacaactggattttcacttggtgcacttggcgatgctggtgattctgtcggtccaactgccccgccggttgatatgagtgatgatcgtggctctgggcgtcataaagaagatgacatgatggctgaggcctaatttttaagaatggctttgcgcgtttttagcgcgcaaggctatagcaaggtgtttagcgatgtgggtacaaaaagtagtgccgtatttgttcatgattccctttgtatattacatttactttgaaaccatgcgaagggatagaattgcgagggagatggccgatcagtggttaaagaccaatcaccctggttgtgttattaagtcgatgaaaacctcaaagttgggtgctcccattgcagtggtgatgcaagtttacacacccaaagatgaggactttgagatcaagttaaaggtgggtactgtctttggaggcatttttgctgaaaaagtaaaggttgtatacgtcagaaagattaagcttgattctaagcaagagtaagtaaaggatttaaggctgagcgatgtgcttagtgtgatacgtgtgtttcttttaggtttggccgcattttgcggccattttttatggctggcattggggtggcgggagtttgtgtgggaattcaagctggcgagagagtacgtatgttaaagaatgtagtgttttgtatttgatattgatcgttgagaaataaatattttgatggttttgggttgattgagaataatcgggacagctttgctaattatggttgctgccccgaaatgcacaagtgaaactaattcatattagctctttgaattagggccggctgactcttttttgatcggtgcaaaggatgtaagggccgccagaattggcttttcgatatgcctgcatgagcaggatttggctttttgcattgttgaagcccatgaagatcagctcgatgtcgtaatcatttccggggtaagccccttcattgtcaccaaagtaatgatctcggttcagatcgactgtgtaggatagggggtggtctgagccgagcggcgggcagtggactatgatttggatgtcggaaaagctggaggcatttttgccgctgaaagtatcttggttctgggatgtcgtgaatggcgcaagtcccatggcaagagttctggtgtaggtgttgtcgtgcttgttcagaatgttgaaatcggcaggaacgcccaagcaattcacgatattgagttggcccattattttctccaggaagttttcatattgcttcagttgatgttgtttggcagagtttaagctactgaggcatatttcctccttcaatagttgaaattgttttgaatttggagtgattttatttttccacggcgaatattcgtagctgaagagtttcacttcacttaatgcatctatgagttgatttctggccgctttatgcggcctttttttatgggcaatgcaatgacagcaacaaccgagcaaatcgccgcgatgctggcctacgcggcggcggccggcgacctggaagcctgtggcgtggtgctggactcgggccgggtctatccctgccgcaacctggccgacgagccggcgcggcaattcaggattgacccggtggaccacgccgccgccgagcagctgggccgggtagtcggcatctggcacagccacccgaacgcgccggccgagcctagcccggcggatagggcgatgtgcgagcgcacgcgcctgccctggcacatcgtcagccatcccggcggcgattaccgctatatcgagccgtgcggctatcaggcggactacctgggccggccgtactgctatggcgtgttcgactgctgggaactggtgcgggactggtacgcgcgcgaacgcggcgtgtcgctgccgcgtccgccgggcgcggaacgggacggctggtggagccgggggctggacttgttcactacggcggctgaggccgccggttttgtttgggtcgatgatgagccgcaggccggcgacgtgctgctgatgcagatacagggtgcgttgccgaatcacacggcgttatggctgggcgacggccgcattctgcatcacctgcgggaccggcagtcggaaacgcacatttacggcgggtattggcaacgggcgaccgtcagacgggcgaggtatcgacaatgagcaatagcactttgcggatgatccgcctgggcggcgtcctgggcgagcagtacggccaggcgcatgaattggcggtgtcgtcggcggcggaagtggtgccggcgctcaatgcgctgtatccgggcttcaacaacgcgctgcgcgccctggacgaacagggcatggcgtttcgggtgacggtggccgacaggacggtttgcgagcaggaactgacgctggtttccagcggcgacatcctgattatgccggaagtggtcggggccagcggcaaccaagtcttgggcggggtgctgatcgtggtgggcgcgttgacctgggcgtttggcggcacgcagctgatggcggtgggcgtcggcctgatgctgtccggggccatgatgatgctgacgccggttccgcgcctggaccagtcgcagagcgagcagcagcagggcaaaaccagttatctgttcaacggtgcggccaatagcagcgcgcagggcatgcccgcgccctggggctggggccggcatcgcgcgggcggcatcatcatttcggcgggcatcagcgtagaggacatgcggtaaatggacagggacatcagaggcgcgggcggcggccagaaagagccgcgccggccagtggaggcgtcggacacgctgcagtcgctggcgacggccagggtgctgatgctggtggggctgggagaaatgggcggactggtcgatggcgaccagtccgttttctttggcggggtgccgctgcaggaccgcaacggcgcgcgcaacttcgagcgggtgcgggtggaacatcgggtcggcacggcggcgcaagcgccgatggccggctttgacgagatcgagacggaatacgcggtcggcgtcgaggtgaaggctggcgacggcatcgtgcgcagcatcgacaatctggacgccacggcggtgcgggtgacggtgtcggtgcgggggctgctggcggtcaacgacgacggcgacaccaacccgacggccgtgacgatggcggtagaccttcgcgagccgggcggggtgtggcatcaggcgcggcaaatcgacatcgtcggcaagacgcgcagcaaataccagaggtctgtccgcgtcgatctgccgccgggcgggccgtggcaagtacgggtgcggcgggtgacgccggacagcacgacgcaaaagctcatcaacgcgaccgagtgggacagctacaccatgctgcagtcgatgcggctgagctatcccggctacgcgctcttgggcgtggagttcgacgcccggcagttttcgtcgctgccggaaatcaccagcgagtggcggctgtcggtgctgcaggtgccgagcaactacgacccggcatccggcacgtatgcgggcgcgtggaacggcacgttcaagccggccttcagcagcaaccctgcctggtgtctgtacaccttcgccactgatgcgcgcttcaatctcaatctgccaccggacggcgcgtggaaatgggacttgtaccgcatcggccaatggtgcgaccagctagtcagcgacggcatgggcggcctgcgccgccgctttgaaatgcacggctaccacggcgacggcgcggacgcctggaaggtgctgcaggacatggcgtcggtgttctgcggcaaggtggtgccgagtgccggcggcatccgcgtggtggccgacattccgggcgacccgcccgccaagcacttcacgccggccaatgtgatcgacggccagttttcctatgccagcacggaacaggctgaccgctacacggtggccagcgtgtcgctggtggacccggaagacggctggaagcggggcattgaatacgtcgagcacgccgaaggcctggcgcgctacggctaccagccggccgaggtggtggcggtggcctgcaccagccgcgcgcaggcgcagcagctgggccgctacatcctggagacggcgcagacggaaaccgagctggtgacgttcgccgccggcctgtatggcgtcgatctgcagccgggcgagctgttcacggtgtttgacccggtggtggccggccggcgcgtgggcggccgcctgctggaagtgaaggggaaggccgtgacgctggatgcgcccgtgatgctggacgagggcgtcagctacagcctggaatgcccgatgccggacggctcgctggtgcaacgcggcgtggtggtgacgccgggcgaggcggccagtctgcgcctggtggctcccttcccggcgcaaccggtggacggcgcaacctgggcgctgatcgggaccaatctgcagccgacgctgtggcgctgcgtcgccaagcgcgagcgggagccgggcatctacgaagtgagcggcctgcagcacaacccgaacaagtgggcggcggttgaacagggcatccgcatcgacgcgccgccggcatccagtctgccggacccggcgcagatgccggcggtgtcggcggtcagcatgcgcgaagtgtcctatctgaccggcgacggccgccgcgcggtgcggctggaagtggactggccaggcgtcaatcatccgtatctgcgcggctacgtggttggctaccgccaggacggcggcaactggctggagctgccggagcaggcggccaaccatgccgagttggaagggctgcagccggggcaatggcaagtgcgggtgtccagcgtgtcggccatcggcctgcgcagcatcccggcgctggccagcatcgacgcgcgcggccatgtcgcgccgccgcccgcgccggccctgtcggcgaccggcgcgccgatggccatcaacctggcgtggacctatccgccgggcgtgcctgagctggtgcgcgccgagttgttctattccgctgatccgcatgacggcaacccggccaggctggcggacctggcctatccggcgaacagcttcattcatcagggcatcggcctgggcgtgcattactactactggctgcgggtgacggacagctggggcaatgtgtccgcgccggccatggcagacgcggcgaccatccgcaatcccgaattgctgctgcagcagctgcaaaacagcatcggcggcggccagctggccgaggagttgcgccagccgctggagcgtctgcccgacatcgccgcgcaggccgacgaggccggcaagttggcggtgtcggcggtggaaaccgcgctgcaaaacgtgctggccagcgaccagctgggcgatgtgcaaacccggcaattcgccatcgcccgccgcgacctgaaaacaaccaacgaggctttgaagtcggaagcgacggcgcgggaagtgttggcggccaagctgggcgacacgcaggcggcgctgatcgaggagcggacggcgcgggccgaggcggacagggcgctggccagcgaggtcaagacgctgagcagccagacggcgggcgacctggccacggtgcgccaggaactgcagacggcgaccggtgagaatggcgcgctgtccaagcggctggaccaactgaccgccaagcatgagaccacgcaggccggtttgctgcaggagcagacggcgcgggccgaggcggacaaggcgctggccagcgacgtcaaatccttgaccagcaaaaccgataccggcctggcggcggtgcgcgaggaactgcaggcggcgaccggggcgagtggctcgctggcgcagcggctggaaacgctgtccacccgcatcggcgacagcgaagccaccatccagcagcaatccaagagcgtggacggactgcgggcgcaatggtcgctgcgcatcacccgcacggccaacggcaagaccttcgccagcggcatgggcttgagcaatggcgagcagggcagcgagttggccgtgttggccgacaaatttagcgtcgcccagccggacggcgagaacgcgcgccaggtgtttacggtggggtcgatcaacggccgcccggcggtcggggtgtccggggatttgctgctggatggcacgctgagcgccaacaagatcgcggcgggggagatccgcgccgaggtcgggctgtacgcggcggccattcgcggcggttacatcaatatgggcggcggccaattcgtcgtggacaacaacggcaatgtatccatcagcagcgggcgcaatggcgcgcgcacggaaattaccaaccgggctatccgggtattcgatgaaaacggcgttctacgcgttcagataggagatttggcggcatgagtgttcatggtttggtggtgaaggatgccggcgggcgcgtcacgatgcatagcgatgccctgtccggcagcctggtggacgtcatcagcctgaccggcggcgtgggcgagcggcattacccggagttgcgcggcttcgcgctcaacacgctgcagatttacggcgcgacggtcggcgggccaggcaagcgcatgcatgcggtgtcgctggactatgcgccaggctatccgctgctgcgctggtggccgcaaactggcgacgtcgccgcgacaaccctttacgtgttgtcggcgcgatgagcttcggtttcatggtgtcaaaccgcaatggcggcattgtggtgagcgaccgcacctattccatggtgtatgtcggcctggccgaattttccggcgtgaccggggcggcgctgccggtgtatccggggcgggaggatatcgccaaatgcggcacgacgatgtgctactacgtcaacaattgcccgtttgagccgctgcccttcatccggcgcaatgcgggctgggcgggcattgtcggcgtccagccggcggggctgaatcgctgggaaatcacggtggtggtctacccggccaatccgccgcaaatcctggtgttttgtcggacgccgaataccgggccggcggggcgctggggcatggtgctgcgcggcccggatggctcgctgcgctatgacagcaaccggcaaaatctggtgctggcggacattctcaatcatgcgcctggcggcatttacccgtgggaaagcatgtggaactgcacgaccgtcacgccgctgcgggtgaataacccgaacctggcgttttgttattcggcgaccggcaaggcaacgaccgacaacaactattggagctattactttttgctggtggcgcggctgtcggatgcggggtttgaaaccaagtattcgacgatagccaagggcgcgcaggtcagcgccggctattacgaccacgtcccgcaagcggtgatggtgatcgacgccagcctgtacatttagggggatggtagtgtacttggtctaaagtgaatcaaggctagtgtcgtaagctattgcgggctagctgcatggttagggagtttggggcgcataaagaatgatctgcatataggtgctgtgattgatgcccatgggaaactaccactgagaggcggctggaaatgaagttagtaaagaaattttcaaactcacttacaattttaagtttgattgtgtgggtgctttttcttgcggctgctataactgctggatttattctgataaattggcgaccgcctgatgatttaactgaccaaggttttaatcatgtattagatattttcaaattcccactgacatgtttggctagtgtgtttgtggtgatgactgtcagggttgctgttgctgcattattagcctcaacccagcaaagtgtagctgcaacgtggttgcttattcaatctggttttttggcatatgtgaagagtgaccggcgtatgtacattgcgtcattgcaagcagatccatttttggatgattttagcggtgtgactgataatgatgtgatgatgggggtgatttatatgagtccgcaaaccacgcttcgtcgcttatttagtaatgtaaataaaattgatggcctggagcctcaggttaatccttttgttttgaaaaagcttgatgatctagaagttttatatgatcgtatcaagcaggaattggcgggaggtgagtcagcatggctcgttacgcttgctgatatggctgtgctagttcgagggctgcgcatatatctcgcagtaaagtctgcaactatggacggttggaagtttccgccggttcttcaaagtggagcattggagcgtaaggccatgccggcgtttgagaggaaaatacttacatcaatcacttttggtatgaaactggagttattgtgtttggcagatgtttttcatttttgccaagcactagaatttaagacgcatagtgtagtgaagatggctgtgggtgtcggtaagattggaagtgatttgtgtagcagaagtggttattctgatgagaagtataggattgaggatttgtgggtagatccgcataggattcaaggggaaaagattaatatttaacttaaagtgcattggtttggttgaggcgtgataggcaaagacttttagtatttactttttatgcttggctagcagttagtcgtgattccacccgcttcggcgggtttttttatgggcgtaggaaatggcaacagaggtttcgtggtatcgggtcgggcaaatcagcgtcgcgcccggcggcctggtggtgaagggggcggcgacccactggcgcggccaggtcaatccgggggatatcctgatcggcccggatggccggctgtatgaagtcgccgaggtggacgagggcggcgaggcgctgacgctgcggactccctacctgggcgatatggcggccggcgcgccttacgccatcgtgcgcaacttcactggctcgccgctgggccaggtggcggccgagctggccaagatgcagcggcgctggctgaccacgctggccggcttccgcgatgtgctgctgagcgaggagccgcaggcgacgctttacgacgagctgggcggcgcgcatgcggtgatgtcctggccggcgatagacaaggccgttaaggcggggctggcgtccatggaggcggcgcgggtgatggtggtggacaactcgggcgaactgatcgccagccgcacggcggcgggggccagcgccaaggccagcggcgacagcgcggcggcgtcggcggccagcgccagcgccgccaaggcgagcgaggacgccagccgcaagagcgcggatttcgcggcggcggcgcaggagcaggcgggcggccatcggcaggcggcatcggcggcggccagcgcggcggcgcagtcggaaaaaagcgcggcggccagcgccggcatcctgtcgagcgcggcggcagcggtggaagaggcgcgcaagctggtgaatgggctggacgcgcgttttgcgacgcccgcgcaagttgacgcggcgctggcgcgagtggtggacggcgcgccgggccagctggacacgctgcgcgagctgagcgccgccctgggcaatgacaaggacttcgcggccaatatgaccgcacagttggccaagaagctggaagccggcgacctgtcccgcgtcggcctgggcggcaatgcgcaaaacatcagtgccggcgcgatgaccgacaagcgcccgaatggcttctaccacgtccaaaccgagacggtgacgggcggcccggcgggcgtgggcaatggcatgctgttggtgaacttcctgagcgacaaatggggcgtgctgacctatcgcgcctggggcggcggcgtctatgaggcccggctcgaaaacggcgtgtggtcgagctgggcgcggcactggcacagcggcaacgatgcgccgctgtcgctgttccggggcgagctggacggcaaggccgatctgaacacgctgcagcaaaacggctggtggtggcaacgcgcgaatgccgccgccgccagcggcgcgaactacccgtgcggcgatgccggcgcgctgagcgtgtccaacgccgggaacatgacgttccagcagtatcaaactttcagcacggaacggccgcggctgtttttgcggagccggtacggcgaggcgtgggggaagtggcgcgaggtctggcacagcggcaaccacggcgcagggtccggcctcgatgccgataccctggacggcctgcagggcgcggacctgctgacggtcagcagcgaccagaccgtggccggcgcgaaaacgttcgcccagccgatccgggcgaatgcgccgggcggcagctgggacagctgggcgggcgcggcgcgcggcccggcgctgcagctgaattgcccggacgcggcgcaggcctacgcggtgtggcgggcaggcaagcccggcggcgagcagctggcggcgctggacgtgcgcgcgggcggcgacaagccggcggcggccgtgctgcacctggccggggagggcgtggcggtcaatgcccacgcctggaccggcaacgactacgcggcggccggcaacatccaagccggcggccggctggtgagcggcgaaatcaacgccaacgccacgggcggaaccgatatcggcgtcgaggtgcgcaacaagcccggcagcgagggcgacgacggcatggcggccatgggcttccattgccagggcaagttcggggtcaagctgggcttgcgcgcggatggcgtgttcggcctgggcggctggagcgccagttcctggcgctggtacgtcaacgccgccacgggcgacatgacggccgccggcaacgtgacgtggttttcggataggcggctcaagaccgacatcgagccgattacggatgccctgggcaaagtgttgcggctcaatggctacaccttcacccggacggataccggcgcgcgccaggtggggctgatcgcgcaagaggtccaagcggtccagccggaagccgtgattgaagctgccgacgaaaacaaaaccctgaccgtcgcttacggcaacctggccggcgtgttcgtggaggcgatgaaggaacagcagcgccacatcacgcggctggaggcccgcattgcccagctggaggccgccgcatgacgctgccggtaaatgggacgctgtcggcgcgggaagtgaatgtcgaggtcagccggcctggcgcggcgctgggcaacgccggggagccggtgttccgggcgctggcggaggtgggcgacagcggcagttattcggcgatggcgttttacggcaagaacgtcatcaagccgctgacggcggcgctatccacctatctggacgagtcaacattcgtcgtgggcatcggccggccacgggtgtatgtcgaggtgacatgcacgcctggcggcggcgtgccgccgtatgcctacgcctgggagatgctgtccgaagatcgcggccatccgttttattcaggcgaggcgaccaataagattttgttttcgggcgacccgaagggctatggctcaacgtggcgctgccgtgtaacggatagccaaggaaaggtggcgtatagccccgtcctgacgttggtatttaaatacagaaagttgggttagtgatgcaagagcatgaaaaggcgctagcggcgctggtgggggtgggggccgctatcgggctgggcaagctgctggtgagccaagagcaaatcacggcgcgcttggcggtggggcgcgccatcctgggcggcggcacttcgacggtggccggcgtggcgctgacgcagtttccagaaatgccgctgcctgccctggtggggatcggggccggcatcggcattctgggcgcgcagtacctggaggcgtggttaaaacagcgggccgacaagatcggcagctgaacgcagtacaaggcatttatcaatctgaggcccgcgcaagcgggctttgtcgtttctgagggagtgaaggttatggaattggtgcaagtcgcaatcagccagctgggcgtggaagagcagccgcgaggctccaacgatgggccgaaggtgcgccagtacctgcaggcggtggggatcgggtttccggcgtcctggtgcatggcgttcgtctactggtgcgccgagcgcgcggcggccgagtcgggcgcggccaatccgctattgaagactggcggcgtgctgaaacagtggaatgagcgtccggcgctgcgggtgagcgcgccgcagcctggcgacgtgttcatcatggattacggcaaggggctggggcataccggcatcgtcgaacgggtggacggcgacaagctgctgaccatcgagggcaacaccaacgccagcggcgggcgggaaggctacgccgtctgccggcgcgtgcgcagcgcgaaactgtgcaaggggtttctgcgggtgggggtgtgagcgtgctggaagggcgtttaaaggccgctggcggcgtggtgttgctcgcggcctggcttgggtcggcttggtgggcgtatggccatggcgtggacgttacgcgccgggaatgggcgctggccgatgcgcagcgcggcgcgacggaagcgcgcgccgatctggccggctaccgggcggaggtcgagcgcctgcaggcgctgtcggtgctgatcgaaaacaagctggaagcgctgcgccaggcgcagccgaaaatcaatgaaaggtataaccgtgttgtcgagaaaagccctttgcccgctgattgccgccctggtcctgagcggctgcgcgaactcaacgccgccatcgaggccgcaaacaccgcccttgccggccaacctggccaggccttgcccgcatctggagccggtgacggtggatagttgggatgcggtggggcgggggtatattgctattgcgatgcaatacggggtgtgtggcgtgcgatctcttcgctagcttggtaggtaaaaaaatgccctgcgctgcagggcattcttcgtagagcttggtgggttttcatcttctgctttcggattcacgtttttagtaatctatttgaattgtgttaattactttggtagggaaaattgcttatgtagaatttttttaaggggggtagagttaatgaaattatttatctttattttctgttgtctaagattgagtaattaactaaatagtctgttgcgtgttttatcaattcctcacgaatagattgtgatgcctcccagttgtcagagcggattccagctagtcccatatatatattcaatccttgatgaaatactttcttgttgctctctattttattaagcatcaatgcctttgcgattattgtacatacaaactgtcgccagcttaattttaaccatcgaaaatctacaccgaatgaaattaattccgaatcattaaatgagcgcgaaaaagggactcttcggccttttagctgtagcttatttgttttttgagatattaaatttgcaactacagtagcatcgccatcaaaattttttgaatcgcaatatataacaattgcatcgcatcgatttgctactctttcattcattatcatttttatggaggttgccggtgagttggcaaaggtgtcaaaaattacgcgtagaatctgcttgttaatttttgatgaagaggtggatatataaactttttcactaatgtcccatcttttttccgtacctacttttctccagactatccaatctttccttgatctatatacttccatgattcctagtgaacttagttcattctttatttctttcgaaaattcttttactgcattggagactttggcggagcgcatgcctctcgagcttttgccgaagtatagcctttccattataagtctaaagtcattccctttttttgcagccttctctataaatcgttgatggaactcatcatatcctcttcctgctagttcgaaatttttgaatacgatataaaggaaatcaaaggtagatagttgttgttgagcattgaatactaatagccaaccattagttatcatagtcaacaagagcgagactgatttttctggtgttcttgtagaagaatttgaaaggattctcaacatttcttgcaggcgagtgcttttgttttctataaggagttgagcaatatcgctgctgacctgctgtcgagatgaaactacaccatttaatagaatgatatatgggttttcgtctgaattgcgttgtattttttttgcaagagatgatattcgatttttcccatagtcattctctaccttgcttagatatgcgcttgcacttgttatggataggtctgggtttgtttttaaggtaaattcattttcaagaagagtaatggcattagacggatattgacattgcattcagttttcctctcagcttaaatccattcttttcgaaaaaaactacactgttatttaatgcttctaagtaaatagagctagcatttgcttcagtgatgaattttttaacaagcttgcttccaatgccgagctttgtcgaattgactctagtgatcacttctgcgatccatgcgattttatagtgatcggtgtagcctcttaaaaatccaagaactttcccatctgaaattgcgattaatgttacccctgttccaatggctgtttttagggattcagcagagaaatctgaattttctccccagccattttcaatgtaaatttcaatcatctgtaagacagtgccggagtctatttcgaccccctgtattatttcaaaatccatatcatcaccatttcaatttcaaacgcaaattgatatttcacttaatggtcgggtcaagaaagtttatgtgtcagattgactcttatccaattggctatttctttatttttcaactgttccaattggtctagatttgaaatggaagggctggagattatattatttaagtactcatttttaattaaatattccaacggatcaaccagtggggtttttaataggaggtggtatattaatgatgcaacggaatataattcagattgaaatgttttttttaatgttttctttttaagccatgcattggcaacatccggagggcagtaaaataaagtagctaccggattttcctctctggtaactttaatgtctagtccttcaattttgcaatcgagccgcgcccattcaaaatctactaggaagacttctccagatgaatcaacaattatattgttcatgctgacatcgccatgaaacatgttgactgcatgtaattttttgtagcagctgattattttttcggaaattttatatctgtcttgtaggctttctttgaatagtgatggtaaggttaatccttctatatattcacaacagagcgtgcctgccgtcgggtcatagctaataaatcctggagagattgctaagctattttcttgtatgtactttaaagaatttgcttcgtttttaagtctgcaacttaatttgtcgtctaatattcttttataaaagaatttcccttctcgccatatgtcatactttatgctgtactctcttcctctttcaaaggagtgacgcactgctcctctttttgtcactatccgctttgctaatagtttcctatgtatctcttttaagttttcaggaagtgattcaagaaatttattttccgactgtaagcaattcgtttcatacttacttagtaattcatcaaaataaatagctgaatttccagttaaaactgtgaccggtatcttaccgtttttatcaatcagaaatactgcacctcgagtagggatttttgcattatttatagtgtttaattctgcgggagaaagatctgtttccttctttataagaatgctggagtgtatttcaaatggcatgatatgtgggtggggcagacaagagtgatccaaattaaatagccaagagggagtggctccccccttggctataagcctttacttactgcatggtatccatcacatcgcaggtaccggaacctccacacttggtttcagcgagactaccgccagcaacaaactccaaatcagcaagggacagctcaatgatttcgctatcaataaacgaagacattgttgcagcggacaagctttctttttcgagcatgatttttccttgaaaatatctgaaatatcaaagcgagctattaaaacaaaatttgccataattttggcggtatttatttgacattaaaaaaaattgaatgtcaacaattcttgagtgcgcaatgggaggagggttaacttgtggggtgaatatattggtgagatttatttgaattaaaacaataagcatagtgtaactcgaccataaggaactcctaaattattctcattttggttcgagcgtgacgatttatttgagggtcgctagcgcgtgatctcttttcactaacatgtcaattaatgaaaacaccctgcagcgcagatttttagaggttgcgatatgttgaaatgcgaatttattctacatggatagttatgcgtaaaaaaaactgtcctttgggacagttttgatggtgtgtgaacaggttctaggcataaggcggaaagctgtgtaggtggtcaaattgctttcccagtgtgattgtggcaaattgattatgcataatgtacgcagttgatttgtactttattgaacagtccacacgaaaaggagctggctgtgaatcctccgtattcattcaaaaatttcaccgagctggaactatttattgatcagctagagagtatcggccaaatggcgggtgccaaagacattcatcataactttctatatgtgaatgagagttatgctgactttcatggaatatcgcgagatgacattgtaggtcagaaatctgagaatatgccaaatggaatttctgtgctatcaaagctcttgtttgagcaggatcagattgttttacataagcggaagaggattattatgggcagcatacatcctcatcgaagtggtgatccgagagcatataaattcagaaaatttccagcactgataaatgataaagatccaatcattctcttcgctggtgaggatctaacttgcgacacaaccttttggagtgagatattgtgtggcattgagccaatggtaaagtttgaaaagttggttgctgcatcattcaatcagttgcaagagcaaaaagaaataaaaatcccacttaatgaaagtgagctatctgttctttgtctcttgcttcgcggagttcctgttaagcgaattgctggcctttttgatctttctacgcgtgctgttgaaaatagagtggagtcactgaaagataaattcggggcattgaatcaacaaaatttgatcgatgtcgcaaggaggaaaggatatcagtctcttttatcgcgtgccatttttaaagaacatatgacttacaatctcttggtagagtgatatgaagctcagtaaaaccattcttatcgttcttctatccacgggtatttttggcttcaactatgttgccgctaaagttagctcaatacatattgatccgctagaaacagcaatgctgagagtggtttttgctgcgctgccagcctgtttgttcttgcgacttagcaagaaagaggaatatcgctatgtgctgctttatgggctagcgttcgcctttggcttgtttctgttttttaaaggacttaagacagggattgatactggaatttcttccgtcattatgcagtctggctcattgtttacggctgttggcgggatttttttcttaaaggagaagtggaataaatttaatattattggctgcttgattgcggggcttgggatttactctatctccaagatcaagggaggaggggtaaatgttgctggaattgcttttgtgctagggtcagcctttagttggacatttgctaacttagccgttaggttgtccagaactgagcgtccattggcctttgtctcctgggggagcttggtttctgcagttattttctttgtaattaatattgtagctggaaagtccattatggatacggtgttgcggattgatcagcaaacctggatggctatcgcttttcagggttatgtgacaacattgattggctatggtctttggacgctgttgttgagtcaaaaccagctagtcttaagtgcccctagttatttacttgttcctggctttgcgttactcttttctcatattgttctaggtgaggttgttacagcagaaaaggtgtttttctctcttattgttgtaataggtattgtcgttaatgcaagttctcagagccttgcttcgctggaaagagaaaagaaaaaagctgcaatgctaacatagctgtattgctttgataaggtggttctcccccctttttttaataattgagataactacaatggccatatcaaaactttgacttgttggggtttagatatggccgattcagaactattgtcattggaaaattttcaaccagaattttgtaagattgttgccgatcatatccagaaagatttaaatccagtagagtgggagcagttgttggtgcttgcacaaactggtattcctcattctccagaactatccttcatggcttttgattccatagaagggcgagttcgtcatttgtcctttgtagaaaatatctccccattggagatgctttctacccctcatttttatcagcggctgcaagttatcgggaaactatatgggcagcctgtttgctactatgcggggtgtggcatctatcagtggagcctaacgcctagtggtgattcgctttgcttctggcttacatatcccgcttaccctccggggtggccagtaggagaggaactggatttgccattcccacgccaagggtttgattcgtattcaaagtatttgatgtgagtggtctggatgagtaagaagaaggagggccggcctcaaagctggaaatggatttgaagaagggtaggaggaggcggaggcgggggacgtaaatggatgctgtaaaaaaacagccacaggtttgtggctgtttcattaaagtttgtacgcaatgctcttcacttatgcatcttgccctgctggaatcagggcgttgttttctaccccttggggccgcttaatgcggccttttttttcctcacgcttgaaggcgggagggaactccagcataccgctgtccgcgcggctaggcaaccatcaagagattcattttcgttgcggtttagttcacgtttaaagcttgttaagcttaatcaagattaagcgagtcttaaaggctctgaagttggtcacggaactttatgccaagctgcatcatgtcttgctgatgagtcttttctagttgattagtcgatagtccttggtctttcagaatggctttttggttttcaaagaccatattgcgtatcctgacttgctcattgtaatcgtgagctagctgatcctggcgagcttttagtgtgtcgcgcgcgaggaaatcaattgagctggtcgttttcgcatagcgttcgtagcggcctacgaacgttgcgcgctgatgggcatgtccgccaatctcgcggcgggtatttgtcattgcagatgcgaccgtaccgccagcgccatctcctttgaccagatcggaatagtcgctatccgtcacaacgggataatttgagctgtcaattttcttgggatcgtctgagtcgcctggcgcgcacttggctaacttctgttcgaatgggctgagtttcttcggcgttaatccgattgcgggattgtatatgacgctcttgctcttgtgccttgcatctgcgatacgttgttgtcgctgccatgcagttgtcgggccgatcatataaaatgaggcatgcgagtcatgaagatgttgatcaaagaaatcatgaacatccttcggaacgggttgcttaccctcttccgattgcagccgcaatagctcagcagcttcattaacttcgctttctactatgcgcgctctggataggtcaccttgccaatctttttcactggcgcgcatgtcctctaagtcttgcttgtcggagcgcgagctgcgctgtgtagcccctttgctaagctgttggatgcaatcttgctgcataaactgcgggctagtcgcaatgcgccaatgccaatattttttcaaatgggcatagagtgcatcttctaccatgcggccgcctgcgttggcccatgccatataggtattaaaacgtttaatgagaagtgggtcaatttcaaagtcttgtgcggcaggatctctttttagggctgaaagagagcgaaggggaacgcctgcagctcttgcgtcgttatacatattgagcaaagctatttgacttagaagctttcgtctatggcctacggccttcccttggtcgccagggccatagccaccgcctacgtcagaatgcgagccagggtaaacaacttcaactgcatttaggggcatgctgccatcttcatgccgaatgctggttaacgggaaggagtaacgcacttcatgcgaggccacataatggcggcactgtttggtgaagctggttacttttaacatgtccggcgtagcccagctgttttgaccatctacgacaccattggctgagcgacctggtgctctccctatccctggtgttgagtgtgccatcccgacggaagcaacagtgtcaaatattcctaagaaataaagacgaatcgggacgcatccggcaaataaccaagtatcgccctgacgtttgcaagatagctccagccagcggcaaaatactctagctaatgcggctccgcgtgagaaaccgaacacggcaatgttgacgatctctattttgggcgtatttttattatttcctatgttgagtgctagttttttttgaactgcatcaagtgaggagaggtcagggaatctaggattaggatttctatctttagctactcttagctcttttttaaaatcttccgcggtgaataggcgctttccattaaatgcaagagatatgtcattgcataattgatagtatgcataacttagcctggcttggccaccggcagccatggataaccccatatctgatggttcattttcgttgatgtctttaaaaatagtccccacgccttgcatgtaatgggtgtaatggtttgccttttgatcatcaattgctgtttcatatagtgaaacaatatttgaatgatcgcatcgatatcttggttttccactatttactgcgtctactaaatctctgtcgcggttgttatttgttccatcgaaaaagaagtttgaccatatgttagtcttgcagcttggctcggtttttttattgacattgttgccaagctcagcttttgtttgaaagcgtgcagctttttgagtggtgctttctttttcaggtgccgggcagctagcattttgtacactcatttggatgcatcctttggcttgatgctgccctgaggccatatcccctctagtggccttgggccatcttctataagtgtgccaaattccttatgggatggatgttctttatggaatagggacatgttttcaacgtagattctagcatcatcatttggcaataaaacaacctgtacttcggccatcgtcttcccatcgtagggagggatggttacagttttgctcttggttgttagtataaatcctccgcttgcatctcttttttcgcactctggagtgtcgtgtatgcaaacacttctctcccattgaagctttacggatgttcctggtttgtattctcttggtaaagtaattgaacctgccgttccgccgccttcatttactcttgggccaccgacccaatgtccatccgcccacaccatactaatgtcgtgatttgtatagttatatgcgccgaccggaacggcgagcatttcatctttgcatccggttagtatggctataaaagatattatgaatagaatacgcatttatctgtccaagagtttattctgatagtgcagctgtaaggagttgccccttgcgggttcgattccagaactcttgccattctgtttcttgatggaagctatcaccctgctcaaatgcaagtgaggcaaaaagggcttggctcggttcatcctgaatgccgtaactgctcatcgcttcagccagctggctaagacgcagatggagcgatgccggtgtttcgtcctggggcagctccacttcatagtgtgcgaggatcggcgggagcatgtccggccgggcgcggtccatcattctatcgaattgcgcttgcgtaaactccaacggttcccacggcgccggaatcgtgggtgtgtcgcgcagggtggccgcctcccattcgccagtgcggccgatccagccccagcgggcgacctgggaggcgagcatcgtcaattgctcgtcggacatcagcggcagcacgttggctagtgtgtgggtgtcggcaaagcgcagcagcagcttttgcccgtcgtcggtgcggaagtcgctgagccagtgccagaacgcgctatccgggacggcatggcggaattccaccacgctgagtagtgggcggccggacgtgatggccagccattccggccaccactcttgcagatgcagcggctctgtccaaattagtgggccgaagtcttccagcgcatccatcggggtgtcatccagcgcgcgctgccaaggctggcggcgttgcagccagcgcttttccttggcgtcgagctggctgccatccatcagccagcagtaatggccgttttcgtttatggccatccattgatgcaactgcggcagcaattccggggcgtggcgattctgcaggaacatggcttaggctccgggcgtggtggtggcgaccgggctgcgcgcggccatcgctttcagtaggcaggggatgcagacattgttggggaactgcggcaagggcggccccatctgatccggcccgctccagtcgtgtttgccggccttgatactgacgttgccaggcgcgtgcagttcgatcttgccatccttgatccagacataggcgccgccgctggtcagcaggatttcttgcttggcgttggcgtggatcttttgcttggccgatgtgatggtcaagtcctggtcggcggtcagttccatggcgtcgctttgcgcctgcagctgcaccttgcctttcgccgcgatcagcttgaacgccaccttgtccttgacgcccgcgacgaacagactgatatgcatgccgacattgtgcagccagcgccggccggtggtgtggttgctgtcgcgctgggcaatcagatccagattttggccggcggccagggtctggctctgttcggtcaggctggcgatgccggccggggcggacaggatgataacgggctgctggccgggaacctcgccgccgccgttggtgttggtgccggcctcccacgccttcaacgcgctggccaggtgcgccaggtggcctttttcttttatgccgtccttggcgttgtccggggtgatttcgtccgggccggtttccatggcgtcggccaactggccggcggcggtttccgccagcgcctggctgagactctgcgcggcgtcgagctggctttgcgcatgttcgcgcgccagttgcttcccgcctgcgccgttctgcgcctcggtggacagtaataggccgtgcccggcgcgaatggctccgtggttgtcggtgcgcagttcgaagccttcgccgcgtggctgggccatgccgtcgctgcgcgggtaggtcagaaagccttgattcagctgtgtcttgcccggctcgctggacagcttggcgcggacttcgccaggcgtgtcgtcgaacagcagctcgttgtagccgccgccctggtgctctttagactggatgccggaaagcgtcttgttggctggcaggctgccggcgccgctgaatgtcggcgtgcggtggctgccgttgtacagcatgccggtaatcaaggggcggtcgatatcgccctcaataaagttgaccagcacttcctggccgatgcgcggaatgaactgatgcccccacgccgcgccggccgaaggcatggccacgcgcagccagcaggatgacttgtcgtccatccccgcgccgatggtcgggtgttcgtccggccgctgccagtggaattgcactttgacgcggccgtgctcgtcggtgtggacctcttcgccggccgggccgaccacggtcgcggtttgggtgcctaggctggtcggcttggcgtgcggggtgtcggcataggccggcgtcagcgggatgccgcgccgttgcgcctggaattcggtctgatagggcgcggtcgtcgagtctgccgcctgcaggcccaagccgggggcaatggcctgcagctgctgggataggtcgcccggcaggttgttgcgggcctggatgcgttggccggtgacgacgaattcgcgctgttccgcgctgtcgccctggtgcgccgggtggtcgtccagccggaaccacgcgccggcctgcaggccgcgcaccgcaccgaaaccggtgaaggtcttggcctgcaggtcgtgcgcctgctggcgtagttgggcgtagcggctgagctggtcggcgtcgctggcgtagtagaggccgggggcgtcgtaatggttaaggctgctctgcagcgcctggccggcctgtccctggtccacctggcttgtgtcgccgctgtggctggtgcgggtgggctggtaatcgtagctggccagcgccacgccgccggcgacgatctggcgcgcggcctgccagtcggtcaggccgtcttgctcctcggtggcgtcggcgcgatggaagcgcacgcttggcgcgctgccggcgggcaggctgaaggcatcatcaaacacgacaagccgcacctgggggctgtcaccatcgacgtgttcgaagcgccaggcgaaaccctcctcatgcatcagccgcacgatgaaatcgaagtcgttctctctatattgcaggcagtagctgcgcgaaggctgggcggcatccaccttgatgtccagcgtctgcacgcgggcaaaggccggattggcggcctgatgctcgctgatgatctgtttgatgatgtcaggcaccgtcatgtcctggaacacgcgggaagtccgacgatggcgcagcaaggcaaagggtggctccaccgtgaggccgtagcgggcaaagccgccatcgctgccgagcaagcgcgcctggctgatcacgccgcagcgcacgtcctcgccgccttcggcattcatcaggccgatgcgggccgggtggcctagcagggacttgagttcaatctggccatccggcgacaggcaatccagctggaagcggtaggggcgggatacgccttcctcgccgtccagcgtctgcggcagcagctgttccgggccggcggcgtcgctggcgatggcaagggtgatgtggcggttattttgggaaaaggctgaggcgaagctggcgagaagtgcggtgatgtccatggttcttccatgtgcgcgcctctgtttggggcgcttgtgcgactgcaacataagtgagaagaacgaaggataaccgttttattgatatggatgtgttgggctgagactgtccatttggacaggtttggcttgcaaatgacgaggtgtttgccctctgttatgataaatgagttcttcttgtattgtgctgatgggttgcctagccatatctttggaaaccgaaattaccatcgttatcaggaaaatttagaaaaggaagtgttatgcggaatggtctgataaatcttgtctttgtttttgcaacggctagttcgcttgctgatggtttgccagaagtcaaaatttttaaagtcgatgttattaaggaaaaggcaggattttctttgggaatgccagcggatgaagtcagtatttcaaatgtcaggcgtgcagataacctgactgtaaaatttaatgcccaagcaaaaggcagagcattccaatgctattacacaggcgcgggagaggtgagtagtgatgcattgtgctcgcctcttgatggtcagcctatgcctgctagtatgcccgtcagtccgctctatcattaatctcagatttctacctgtaatttaataattaagttttgttaggacgcatgtggcaattgattactcaaaaactcagtccattcttaaggatgaattgatagattacggtgctgctgttgagtttgtggcaagtcatgctgatgcagctgcttttgcttttttcccatctcatcgaaatgggaaggttgtaggcggaacagtgtttgctatcactagtcaaacagaggaagtgtcagacgaacattggacgttagagacttttgggggcttgtttcacagtagtagtggcgaagaggatactttatggccggaagacctggaggaattagattttcagggaatttatggagtagattttcgcaggcttagatataagatagtagtacggggattggtttcccgtgcatctagtatggagacgcaatgttctcttggaatattgcaccagtatgatggcgatattgaactaaacccggcatttggtttgtgcgtaccggatgattgggagaagtggctgagtatgcatctgccagttaattgagtgaggattaaagattataaaaaaagcgcccaaaggcgcttttttttatgagacttatcttggagttagatagccagtgtttccatagctttgccgctgtcgatccaagcctgtacccaggcaggttttcgaccacggccggtccacgtcaggctgctatcatctggatggcggtacttggcttcaacgggcttgcgagtgccggcgattttgctgctcagcacatcttctacgctcaggccaaaggagcgagccagttcgagaatctgcttcttggccttggatttttcttcaacttcgcggcgtttgatttcgccttctacgtcagccttcagggcaatcagtgcggtaaattccagcttggacaaatccatgagatatccctcttgattataggtttgataatttcaggctgtaatgtagctaatggtagtggggtaagtcaagaattaaaggatttaatttaaattttctttcaacttctcattgcttccatcaatttagcccatggctcatctttgcgaaagagaatgtacctgtcaggccatgtaggccaatactttcaagacatcttgcggggcacggccggtaataatgaggaatcggcgccatagctcgtagggcatgacaacactgccatctttgaacgatcggatgcgccgatctctattcttgccacgcaagcctagcaaagtgccaagttgcgcatcggtcccatattcaggaaaatgcatttgaaagtggcggaagtatgcgccaacgatatccggcgagggggcttcccagccttcatcttgtcgtaataagtggtcgcgcttgtactggctttcatctacttcttgctggccaggaagtacgggggcttgtagatttgcttgcaagagagcaatggcttctttggtcgcctcctcaaaaatgaatttctgctgatcagcgatgcttggaagatgaattttcatttgggtgcctcaaggatgggtaggccagtcccaagccttgaggcttggggcgggcttacttaggtggcagctggatattgcgaacgtctgaaaccttgatgttaaccaagctcaagctaccagttgctatgccttgccagtatccggcatgatggatgtgcatcatgacgtagtacagatagtcaggtaagagcatgtcggttgcttcgatccgtatgccaatatgttcagggttgaactctcggattggtttgccgcatcgatctgctgagcctcgcctgatgatccaaaaatgggcttctggaaaattagtacgaatggttgctaattgtgaaagtttcatgccgttctcaaggcggcgacgactagccccctcggactgctgagtggctttctgcgcgccacctaatatccacatgttaggctaaattagcctagatgtaaagggcgggaggctttttggtgctgtgggggaattgtgggggggtgtagttccgcgtggttccgcgtcatgctaggttgctacgaattttcagtaagacaatcctgtaagttgttgattttaaatgatggtggtgcgggcattctgcatggggtgcagggggtcggaagttcgaatcttctcaccccgaccaaaaccaaattcagtttgatgaaaagcccggatcattccgggctttttgttttcctcccgcggtttctccgcgtcgtttgattttctccgcaactgatatattctgctattccgcctttttgaataaacgggcggttatttccgcaagattttgttttcatttgtgttgagcaatggatttccatgagtacgacccgtcccgattcgccttgcatcgccctgtgttcgaccgcgcttggcgacaatgtctgccgcggctgcgcccgcactttcggcgagatcagccagtggtgcttcatgggcgcggatgagcgcgaagcggtatggagccgcctgccgcagcggcagcggctgttgcagctggcggccgcgtgttcggcgctgctggagctggacagcctggatggcgtcgagtggggcaggttgccggacggctcgcactaccggctggaggaaggcggcggcgcgctgctgcggcgtgatgccgcggggcgggacgaacagctgtgttgcgagggcttgacgctggagcgggcggccagctggctgctggcgcaacgttgattttctggaggacgcatgcaggatagttcgcagccgcagttttgggagcagcgctaccaggagggcgtgatgccttgggagggggcggagctgccagcgccggcccgggacttcttttctggccaggtgccgatgcgggtcttgctgcccggctgcggcagcgcgtcggatatgccgccgctgcacgccatgggccatcaggtgctggcggtggacttcagccagtcggcgctggatctggcgcgcaggcaatggccaggcctggcggacaagctgatgctggccgattttttccaactggatttgcccgctttcgactgtgtgttcgagcgggcttttttgtgcgctttgcccattgccatgagaaagggatatgctgatggcgtggcgaggctggtggcgcctggcggagcgctggccggggtgttcttcctggcgcaaaccgaccgcgggccgccgttcggcattgcggaggcgcaattggaagcgttgctgggtaattggttttcgctggaggaaaagcaattgttgccgactggattgccagtgttccgcggccaggagcactggatggtctggcgcaggcgcaagcttgatctggatcaagctttgacggcgtgaggttctggccattcgaatcgttttaagaaaaaataccgaccaataaaaataatgatgcggactgttcaggaggagagcaaatggagtggttttggcgtctttacacgttttcggaaaaaaacttctggaataccctcagcagaaaattatgcagcttcttcttcatcagcggctttcagcttttgatggtgggatattgctattacgcgctgtctgatatccgcgcgactctgcggacggccggggtggcgccgcaggtgctggccagcgtggagggaaatatcgacagcgcgttgtcctggacgctgggcttatggctggtcagtttcgtcttcatcgctttcatggtgtggtatctgcgttatctgatcgtgcggccgcttaacatgatcatccagatcttcaatgaaatcggcgccggcgccggcgacctgtcgcgcgagattcccacggtgacttacgatgaaatccgcgatctatcgctgtcgtacaaccgtttcctgttgaagatgcgcgagatcatcagcaacgtccgcctgatgacggtgcgcatcgcgatggactcggcggtgacgcggcgcaacgtcaccgaatcgctgggcagcgcgcgccagcaagacgagctggccaggcaggtgagccaggccagcgagcagagcacgcgcggcgtggagcaggtgaccgagcagaccgaggcgatttccgccaccacggcggaaaacttgaaggtggcgcaggagtcttgcgaggaattgcggctggtgaccggcagcatccacgacatcagccgcaaggtgggtcatttcaatctgacggtggaggatctcagccagcgttcggcgagcatcaagaccatcgtcgatctgatcaaggacgtgtcggagcagaccaatctgctggccttgaacgcggcgatcgaggcggcgcgcgccggcgaaagcggccgcggcttcgcggtggtggcggacgaggtgcgcaagctggcggagcgggtgaaaaaggccaccgacgaaatctcgcacaatatcgatggcatgctgggcctggtggcggaaacgcagcaggagacggcggcgatcacccaggatactaatcaggcgcgcgacgtgatttcacgcgcttccgagcacttcagcaagatgatgggcgacttcgaggccacctcgaccagcctgagccagatcgcggcgaccatgcacgatttctccgagtccaatcaccaggtgaacgagcacgtggcggaaatccacgtgttggggcggcaggtgagcggccgcctgggccagaccgagagcgcggcggcggagttgaccgcggcagccgagcaggtgcaggaactggtgtcgaagttcgtgatcggcgacggcgtgttcgatcaggcggtgaatcaagcgcggggagtgcgcgacgaggtgcagcagctgctgcaggccgaattgcagcgcggggtggatctgttcgatcagcgctaccagcccatcgcgggcaccgcgccggtcaaataccgcaccgtttacgacggcaagctggaaaaactgttgcagccgatgctggacaaactggtgggcttgattccgggaggcaagttctgcgtggcggtggatggcaacggttacgcgcccacccataacagctggtacagccggccgctgagcggcgacgcggcgcgggacttggccgaaagccgcgacaagcgcatcttcaacgatccagccggtttgcgcgcggcgcgcaacaatcaaccgttcctgctgcagacttacagccgcgataccggcgaagtgttgtccgaagtggtgctgccgctgcaactgcgcgggcggcattggggggcgctgcgggtgggcttcgaccccaacagcctgctggctcaaggctgagccgagggtgatgaggcggggaggcggaagcctccctttttttgggtcgcttagagagtcagcggcgacatcagcgtgatgacgcccagcaccacgaacaataccgcggcgatgccgtgcatcagtttttgcggcagcttcttggcggccacttcgcccagcagcacggcgggcacgttggctatcatcatgcccagcgtggtgccggccaccaccatcggcagctcgtggaagcgggcggccagcgcgacggtggcgatctgggtcttgtcgcccatttcggccaggaaaaaggcgatgaccgtggtgccgaatacgccgaagcgttcgcgcaggccgccgtcttcatccagtttgtccgggatcagcatccagaccgccatcatcacgaaagagatgcccaggccccagcgcatgaagtcggggccgatcttggtcatcagccattggccgacggctgccgcggcgaagtggttcaccagcgtggagacgaaaatgccgagaatgatggggatgggtttcttgaagcgggacgcgagcagcagggccagcaactgggtcttgtcgccgatttcggccaaggccaccacgccggtggaaatcaggaatgcttccatgggaactccaggggccgcgcgtgcgccatgacaaacctgcgccgcggccccgcgatacgcaagcatgtcatgggtcttgccaaacggaagctcgtcgcaagcgccatggccgaagccaagcatgttgacgcttgccggcgctgtcgcgcgccgaggctactcccccagaacgagccggattgtaggggaattgcccggcgtcggcaagcttagtcgagctgagaggtgcagcaaggacagcgggtggccttgtccgggatggacgataggcagtagcggcattccttggtggcgggcgcagcgggcgccggagcggcttcctcgcgcttgaggcggttgatggccttgaccagcatgaagatggcgaaggcgacgatggtgaagctgaccagcgcgttgatgaacagtcccaggttcagcgtggtggcgccggcctgcttggcggcggcaaccgatacataggggccggcttgcttggcgccgtctttcagcacgaagaacaggttggaaaaatcgacattgccgatcagcaagccgatcggcggcatgatgatgtcgtcgaccagcgatttgacgatggagccgaaagcgccgccgatgaccacgccgaccgccaggtcgatgacattgcctttgacggcgaattccttgaattctttcagaacggacatgcaacctccttttttgatttaaataattttaactgttttgttgttttgtgaaaactcaggccgcttgatcggcaggcttgcggttgtcggacaacgtgcctagcagcgctcctcccaggatcagcaggatggccagcagcgccagcgggttcaactggccctggccgctgacggccagcaacagggtggacagcaatggcgtgacgtaggaaagcgagccgatctggcgcgggtcgccatgcttcagcgcgcgctcccacaggaaaaaggcgccgcccatcgggcctagtcccagcagcagcaaggtggcccattgcagggcgctgggctgggccgcgggctcgaacagcgcatggcacagcagcgacaataggccggaaatcaggcagaagccgccgacggcgctgccgggaaagtcggggagcctgcccagcgccaggctgaaggtcgaccatacgatcgcggcggccatggccagcaggtagccgggtaagtattgttgggacaagctcagagagccgccgctgacgatgagcgccgcgccggcgaagcccagcgcgccgccgatcaggtggcgggcgcccaggcgcgagccggggcggaacagcggcgtcagcatcacgatcagcagcggccacaggtaattgagcaggttggcctccagcgcgggggccatgcggaaggcgaagaacagcaggaagtggtagccgaacaggccgtagacgccgaccagcagggtggggatcggcacgcgccactcgcggatgcggggcagcgccagtaggctgcctacggtcaggctgacgccgaccacgaagaagggcggcaacgagcgggtcagcgcgcccagggtggcgagcgaggcccagagcgcgatggctccggcggcgagcagggtgggtttgctgggcatggcgtctccaaggatggagattgattgtaagtgggaaacgccaaacgaaaaagccgcagcgtaggctgcggcttctcgtgcaatctggctccccgagcagggctcgaacctgcgacctgcggattaacagtccgtcgctctaccgactgagctatcagggaacaaaactttgaaatcgggcggcgtgtggctccccgagcagggctcgaacctgcgacctgcggattaacagtccgtcgctctaccgactgagctatcagggaacacgcgtctcaaattgtccaaccttaggatgggttggctccccgagcagggctcgaacctgcgacctgcggattaacagtccgtcgctctaccgactgagctatcagggaattgagagggcgaactatatacgcggcagtcaggcgtgtcaacggttttcgcggcgacaggggcgattttctttggggttttgggtggggagcgggtaggctcttgttatggaatgaaattttccgctccccggcattggcatggtttgcgctgctggcgacggcgcattgcttggcgttaagatcgcggatggaaataacgattcaaaggatgggaagcatggacgcgttctggaatgaatggctgggacagaagggcctggcgagcgacggcgagttgccgcttggcgagcgattgagccaggtcgaggctttgctgcggcagtcggtgttggcgccgttggcgaatttcgccgtgataaaagcggaaggcgaagacgccgctgcctttttgcaaagccaattgtccagcgatattcgcgagctggtagaaggccgggcgcagtacagcacttactccagcgcgaaaggccgcatgctggcgagttttatgatttggcagcatcaaggcgcctattatctgatggtggcggcggatattgcggctgcgatagtcaaacgcctgaccatgttcgtgctgcgctccaaggtgaagatatcgctggcggacgaatggtctttgctgggaatgtcggggccgcaggcggttgaaactttgcgcaaatatttcccgggcgtggctggattggagagcttgcaaacgctgagcgccgatggcgcagtgctgctggccctgccggaggggggctttatgttggcgttgggcgaaaatgcgtcgctgcggcaggatattgccgcagccgagctgcgcccgcttgcgcctgagatctgggcgctgcgcgatatcaatgcaggcattgcctgggtgtcgcaagccactcaggaacagtttgttccccaaatggccaatatggaattgatcggcgcggtaaatttcaagaagggatgctatccgggccaggaaatcgtcgcgcgcagccagtatctgggcaagatgaagcgcaggatgttcttggtggagttctcgcaagcgctggctgtcggctccaagctatatagcccgcaattgccggatcagagtattggcatgctggctgcgtcgtgccaggtggctgaagaccgttatcgcggcctggcagtggtgcaatcgcagacctggtcgtctggaatattcggcgatgaagcgggaactattgcgctgacggctttggaattgccatatgcgctggaatccgtaacagaataaggggtaatgcgttttctttttaattcttgacttgtcccaattgcattggctacattacatcctgtaatcggtaaaccaataatcaaggaacatgttatggatctgtccaagctggaattcaccgaactggtcacgctgaaagctgacgttgaaaacgaaatcaagcgccgtgaagttgaagaaaaatccaaagccaagaagcagattatcgaactggcccgcgcttacggtttgagcgttgaagacgtattgagcaagaccgtcgccgtgcgcaagccggtggaggccaagtatcgtcacccgtccaacaacgagttgacctggaccggccgcggccgcaagccggcatgggttcaagcctggatcgacagcggcaagtcgctggaacaactggctatctgaacttagtcattcgcattacaaaaagcgccgccatggcgcttttttttcgggtgcgccaagcggcctgcgatagcgttttacgcttgctataaatacttgtagcattgctcagggcagtgctgcgacgcggcaccgggttttgaacgagactggacaagcgcatgctggatttcttttcaagggggtccaagggcaagccggatcccttggccaatgcggcggcggccaaggcttatgtcgatgctttgcgcatggagtttggcgcgtccgcgcacgataaggtggccgaactgctgggcggcctgaattcgccttcgctggaactttccgccgacctgctggaggcagtgctgaccctgaatctggagacgcaggcgctgcatgataccttgtgcgtccaatacctgatgaacacccggatgcccaaggtgctggaaagccagttgcgcgggcagatccttaattatggcaagcagtttaccgatttttatcaatatgcattgccggcctcagcagataatcccaatggactgaaaatacgcagccatctgccgttggtgctggctcgcatgctgcattacctgaccgaatatgccagatggcaatatattcgcaactttcagccggatgaagttttctggatgaatgccaatcagctttatcgttttgccgagcagcgcggtttcgactcccagccggtattcctgttcggcgagaaatccgccgccactaccgtccaggacctatacctggcgttgcaaatgttgtcggtgctgtgcaccggcaacctcagcgtccggcaaatcaacttctcttatgagttgctgtcgctgctcagcaaccggatgacgatgaccaaggcctatttcgccgaggccagcttctctgtcaccttgaccgatcccaaacccgccgccagggcgcggggcgcggggggaggggagcagacccgctattggaataccgcggatatggtggagatcctgcacggctgggcgatcgtgatggagggcgggcgcattccgccggagttgaagcgcctggtggagccgggcatagacgccgggctgctgcgggtgctgacgcgggaatgggcggccaagccggtggtgttcgagcgggcggagcgggtggcggtcagcaaccgccatgtcgaggtcgcgcaccggctgaccatattgcacaagctgatccgcaagccggacgaagagtcgatgcagcagcatcgcggcgtcgacagcgacagctacgacgatgcggccaatatccgcatttacggcttcgtcaccagccgcaagcgcgacaaatcgctgtcgccgctgccggccggctcgctgtcgatggccggagagaccgccgaggccggcacgccgcaggaattccagaagtgggcgctggaaaatatcagccagaccggcttgggggtatcgctggatgtgatgggcaacgaatgggtgagcctgggcagcctgataggttttcacgaggcggatggcgagtcctggaatctcggcatcatccggcgcgtcaagcgcaccagccgcgagcgcatctacctgggcatagaaacgctgagcacccggccgctggcggcatcgctgcggccgaccgacgccagattgatcgaccccactctgccgcccgaccaggtgtggctggccggccatatcagcctgttcatgccttaccgccgcagcggcaagctggtgaacgcgctgatcctgcccttgtcgctgtacatgcttggcaagcagttctacatgagcgcgcgcggcaagcatttccagatcgcgctcggcaaggtgctggaaaaaggcagtgactggtgcatggtggaggtggagctggtgaagacgctggacaagttgccggtggtgctgtgaggccgccgccggcatgaaaaaagccgaccccggggtcggctttttgttggctggcgttgcttattcgccggtcagatcgttcagaaccgcgtagatcggcgacagcagggcttcgcccaggcgcaggctgcgctggccgttccagccgaagtcgtcgtccggcaggttgttgttgtccttgaacggcatttccagcgtgaaagccaggcagccgaactgttcgcacacccagttggtggcgatgcccatattggctttgccggcctcgttgcgcgggtagccgtgttcggtctggtaatccgggctggccagcagcaggtggtggcggaagttgtcggccagcgcctccagcttttcgttccaggacggcacgccttcggtgccggccaggaaaacgtaggggaggttttcgtcgccgtggatgtccaggaacaggtcgacgccggtttccagcatcttttcccgcaccagcagcacttccgggctgcgctccaggctgggttccgaccattcgcggttgaggttggcgccggcggcgttggtgcgcagattgcccagcaccgagccgtcggggttcatgttcggcaccacgtagaaggtggcgcgatccagcagcgcgcggctggttgggtcttgcgggtccagcaggcggttcagcaggccctcgaccagccattccgccatggtttcgcccggatgctggcgcgcggtgatccagatcttcagatcggattcgacttcgtggcctatggtcagcaggttgatgtcgcgtccctgcacggtggagcctaggtcggagacctggcacaggccggagccctgcgcctggccgatcaggttcaggtgctgctcgtaggagtagggttcgaagtaggcgtaatagatgctgcccgacagcgggacatgctctatcgtcatcacgccgtcttcgtagcgggtgggcacccggaaccagttgatgcggtcgtaggaggccatcgcctggtaatcgacccagccttgcgggtacgcgcactccccggcattgaggaagcggaagttgcagtgctggtaggcagcgccctgagcgcggaagtagaaccattgcgcgaattccgcggcgttgtcgcggcggatgcgcagttggatgtcctcggcggtgtcggcggagacgatttcgatgctgccggcgtcgaagttgctgctgattttcatgcgtggaacccgtagtgcttgctgaatctctagaacccggattgtaaacctgtcgcgggggctgcgcatcctttaataaaggaaaagccccgccggtgcgtggcggggcctggagggcggcggcgggcgcttaaacggtggcgccgcgcttggccgaattcttcaccgcgtcggcggtggcgctggtggctgccttgacgctgctgtcggtgaattctgcaacttgctgggcggccttgctgaaggtgttgacggcggcggcggcggcggcgaacgaggttttcaccgcgttcagcgtggcgtcggagccggccggggcgttcttggccaccgattcgatcgagctgatcagcgatttgttgaaatggccgacgctttcctcaaccagcttgctcagctcgctttgcgcgccggaaaccacttcgtacagattgcgggaatggctgaccgccttgtcgatggattgggtggccagtttgttcaggtgattgaccgcttcttgcggatccttcagctcggtcagctgcttggcggccttggtgttgtcttccagcgattgcttggacgcgtccagctgcagtttgaccaggcgctcggcgctgtccagcgcgatttgcgcgaagcgcagcgtggattcgaagccggcgagggaaagtttgttcagctgttcattgttgtaggacatggtgtaaaacctccattgcgtggaaaatggggccaacgatttccgtaaagatgattgtgcgccgcacaatgacgtggaaatgtagcacgccgcgtctggaggtggtagaagatttactctagtctgttgtatttatgttagattgccagcgcacaacgccacgacaataaccaggagcgttaaatgagtgttgagaaacgggtcatcaagaagtacccgaaccgccgtctgtacgataccgccaccagttcctacattacgctgggagacgtaaagcagctggtattggacaatgtcgacatccaggtgcaggacgccaagacccaggaggacatcacccgcggcgtgctgctgcagatcattctggaagaggaaaacggcggcatgccgatgttcagctacgaagtgctgacccagttcatccgttattacggccaggcgatgcagggcatgatggggcctttcctggagaaaaacctgcagcttttctcgcaactgcagcaaaaaatgcaggaacagacgcgcgcgatgtatggcgacaacgccatgctcaacaccacgctgtggagcgagttcatgaatctgcaggggccggccatccagaacatgatggctaactacatggagcagagcaccggcatgttcctggaaatgcagaaccgtatgcaggagcagaccaagcagctgttcggcggcttcggtttccccggctatccgggcgtggagcccaaggacaagccctgagccgcagcttggcggcgcgcggcaccgataccggccggaggcggatgcgtctccggctttgtcgtttgacgacggagcaacgatgagccaggaaggcggacagcgcttgcggcaggcccagcgccggcatctggccggcgaaaccgctggcgccgaggcggattaccgcgccttgctggcggatgcggcgatcggcgtcgctgcgcggcattggctgggttttctattgctgcagcaaggccgcctggaagaggcgcggcgggagctggcgcaggcggtggcaatggatggcggccatgccgagtggcatttcaacctggggctggcctgcgcccggctgggacgccgcgacgaggccatcgcggcgttgagggcggcggtggccggggatggcggccgttacgcttattggacgaatctggcggcgctgctggacgaggcaggggacgacgcagaggccgaacacgcctgccggcgcgccatcgcgctggaaccaggcagcccggacgcgcatcacctgttgaccgcgctgctgctgcggcagggccgcttcgacgaggccaggcgcagcaatgccgaaggcgtgctggccgagccgccgggcaagatggcgccgatcgcggtgggacaggcgctgtgcgaactgggccggcgcgacgaggcgcaggcgctggcggagagctggctgcggcagcagcccggccatccggtggcgctgcacatgctggccgctttcggcaagggcgagccgcccccggtctgcgacggcgcctatgtgggccgggctttcgacgccgctgcggccgatttcgaagcggcgctggcgcggctgcgctaccgcgggccgcaatggctggccgattgcctggcaggccagggcatcgcgccgcgctcactgtccgcgctggacctgggctgcggcaccggcctagccggcgcggcgctgcggccttacgccagccggctggatggcgtcgacctgagcgccggcatgctggcgcaggcgcgcggcaaggcgctgtacgacgcgctgtcgcaggctgacttattggactttctgcgtgacggcggcgactgccgttatcagctgatcgcctgcatggacaccctgacttacctcggcgagctggcgccgctgtttggcctgctgcgccggcggcaggggccgggcgggctgctgctgttctgcaccgaaaggctggatgatggcgacgacgctgattaccggctgcatcacagcggccgctaccgccatcacgcccgctatctggagcgtctgctggcggacggctggcgggtactggcgcgggagcggctgccggtgcgcgacgagggcggctgtccggtggccggcgaattcatttgcgcgcaacgcgtggacagcgtgggcgagccgggcgcctagggttgtagttttaaaaaatacaaatatatgcggcggctatttgtaattaattgtgattgatgcgccgccagagtttggttattgatatagccgccgccatgcgcaggcagccgccatcgccagcgcaggccttccgtcaatcgatgccaaggatgaccgcgatgcgcgccaagaccacgctgcccctgctgttgctgctctccctctccccgctggcccatgcgctgggcaagacgcccggcacttacacccactaccgtttcccggcggccgcgtcggccgggctggacgcggtggacttcaccatcaccgtcaagcgcgatccgggctattccgccaatgtgtactgggccaaccagttcgacctggtcggcacttccggcgcctacaccggcatgcaaagcaatggcggcggggcgcgcaccttcctgttttccgcctgggacaccaccgacgccaagccaggcagcgccggcagctactgcaccaccttctccggcgaaggcaccggccgcagttgccgcatccatgtggactggaagcaaggccatagctaccgcttccgcgccgcctacgagccgggcggctggctgggcgtgaccgtcaccgatcagaccgatggcagctcgttcaagctgggcagcatcaagaccgccgccagcaagatctcgccgcgcaatatggtgaactggaccgagtatttcgagtggaacaacagccgctccacctgcctgggccagccctacagcctggccgccttcgccgcgccggtcggcagcgcgggcggcaagacgatggcggccgccatcagcggcagctcggtcagcgatgcctgcccggcgtattccaaagtcacggtctacagccaatccagcgagcaggaaaacggcatcggcaacagcgcgcgcgcgcccatcgccaacgccggccagtgcctggacgccaagggcggcctgggcgacggcgtcgcggcgatcatctacgcctgcaacggcggcgccaaccagtcctgggtgcatgcggccgaccagtcgctgcagctgcaaaacaattattgcttggaagaaaccggcagcggggtggaggtgcgcagctgcagcggcaagtcgcgctgggagctggcggccggccatgtccgcagcctgcgctccggcttgtgcctgagcgccaatcggccggggcagccggtcagcctgctgcaatgcggcggcccgggacagcagtggtcgctgccggcggctgccgcgcattagaccgcggcgggcctgagcgaaacggcgcgcgatgggcgcgccgtttttcattctgcatggactttgacctggcaaccctttcattggcatggttgcgggtataatggccgccaccgtttatgacgaagccatttcaacgccatgtcccatccgccacagacgatagccggaatcgcttcctgcgatctgctttgctgcccaccgtcgttcagtctgcgcgaagccgccgcccgcatggtggccgccggctgcagctccatcctggttcgcgatgacgacggcgccatccacggcatctggaccgaggccgacgcgctgcggacggcgctgacgccagcggacgccgacgcgccagtgtcgcgggcggtgggcgagccgccggccacgctgccgcacgacatgccgctgccggacgcggtggcggtcttccgcagccgccagctgcgccacgcgctggtgttggagcatggccggccgctgggcatgctgacgctgaccgatatcgtccgcaaccagggcgtggagtccttcctcatcgtcaagcgcgtcagcgacttgccggggccgccggcggtggtgctggccgggagccaggcgccggccgaggcgctgcgggtgatgcgggagcaggcgctcagcgccctggcggtggccttgccgcagggcggcttcggcatcctcacccagcgcgacgcgctgcgctggctggcgctgggcgggttcccggccacgctggccgagggctgccgccagcccttgataggcgtgccgcgccatgccagcctgctgcaggcgcggcagctgatccagcagcacgacatccgccacttggcggtgttcggcgacgatggcgcgccgttgcggctgctaggcttcgacgacatcgtgcgcggcatcgagcacgaataccagcatgagctgaacgcggcgctgcgccagcgcgacgaggcgctgcagcagtcgcgccacagcctgctgctggccgacaaggtgttcgaatcgacgatggagggcatcgtcatcaccgaccgcaacggcctgatccagtcggtgaatccggctttttcccgcatcaccggctatagccgggaagaagcgctggggcagacgccggcgatgctcaaatccggcaagcagccgccggagttctaccagcagctgtggcgcagcctgctgcgcgacggccgctggcagggcgaggtggtgaaccggcgcaaaggcggcttgctgtacaccgaacacctgagcatcaccgcgatacgggacgccgccggcgaatgcctgcattacgtggcggtgttctccgacatcacccaacgcaagcaggcggaggaaaggctgcactttctggccaaccacgacgcgctgaccagcctgcccaaccgcacgctgttcctggaaaaactgcagggcgcggtggcgcgcgccgccgccgaccgccgcggcctggcgctgctgttcatcgacctggaccgcttcaagctggtcaacgataccctgggccaccacgccggcgaccagttgctgatccgcatcgcgcgccagctgcaggcgcggctgcagccgacggaaaccgtggccagactgtccggcgacgaattcaccgtgctgctggaaggtgttgacggcgtggcgcaggtggccggccgggcgcaggcgctgctggacgccatcaccgaattgtccggcgccgccggccagcaagtgttcgtctccgccagcatgggcatcagcatgttcccggacgacggccgcgaggccgacaccctgctggtgcatgccgataccgcgatgtaccgcgccaaggagagcggcaagaacggtttccagttctacaccgccgacatgaacgcccgcgcgctggagcggctgaagctggaatacagcctgcaccgcgcgctggcgcagcgcgagctggagttgtggtatcaacccaaggtggcgctggacagccggcgcatcatcggcgccgaggcgctgctgcgctggcgccaccccgagctgggcctggtggcgccggaccgcttcattcccattgccgaagagagcgcgctgatcgtgcagatgggcgcctgggtgctggacgccgcctgcgccgacatccgccgctggcgcgacgccgggctggacgccggacggctggcggtcaacgtgtccggccgccagctcaagcatggcgatttcgtgcggcaactggagcaggtgctggcggagtacgggctggacagcgcggcgctggagctggaaatcaccgagagcgtggcgatggaggagggtggcggcatggtggagacgctgcgccggctgcagcggctgggggtgtatctgtcgatagacgacttcggcaccggctattcctcgctggcctatctgaagcggctgccggtgcgcggcctgaagatagaccgctccttcatcgccgatttgcactgcgacagcgatgatgccgccatcacccgcgccatcgtctccatcgcccgcagcctgggcctggatatcgtcgcggagggcgtggagcgcgaatcgcagcgccgtttcctgctggagcagggctgcaactgcgcgcagggctatctgttcagccagccggtgccgcgcgaggcgttcgaggccttgctggcggcgcaggcgcggccgcgcgcgcctgcgttgctgcagaaatgaaaaaaaccggcatcgcgagatgccggtttttgcaagacgcggacgggaatcagccgccgatcttgtccttgcccatgaaggggcgcagcacggtcggcacggtgacgctgccgtcggcgttctggtagttttccagcaccgccaccagggtacggcccaccgccaggccggagccgttcagcgtgtgcaccagctggttcttgccgttttcgtccttgtagcgcgccttcatccggcgggcctggaagtcggtcatgttcgagcagctggagatttcgcggtaggtgttctgcgccggcagccagacttccagatcataggttttggcggcgccgaaacccatgtcgccgctgcacagcgtcaccacgcggtagggcagctccagcgccttcaggatgttttcggcgtggcccaccatttcttccagcgcggcgtacgagtgttccggcttctccacgcgcaccatctccaccttgtcgaactggtgctggcggatcatgccgcgggtgtcgcggccgtagctgccggcctcggaacggaaacacggcgagtgcgcggtcatcttcagcggcagctcgtcttccttcaggatggtgtcggcgacggtgttggtcagcgtcacttccgaagtggagatcaggtattgcggcgcggcgctttcatcgccgccgcgagtcaccttgaacatgtcgtcggcgaatttcggcagctggccggtgcccaagagcgcggtgtcgttgacgatgtaaggggtgtagtgctcgacgtagccgtggctgccggtgtgggtgttcagcatgaactgggcgatggcgcggtgcaggcgggcgatgtcgcccttcagcacggtgaagcgcgcgccggacagcttggcgccggtgtcgaaatccaggcccagcggggcgccgacatcgacgtggtccttcacttcgaagtcgtactggcgcggcacgccgacgcggcgcacttccacgttctggctgtcgtccttgccggccggcaccgattcgtgcggcaggttggggatggtcatcagccagccgtccagttgcttctgcacggtttcaaaagcctgttcggccgccttcagctcgtcgcccagggtggcgacctccgccatgatcgcggagacatcctcgcccttgctcttggccgcgccgatctgcttggaagacgcgttgcgcttggcctgcagctcctgcatgcgggactgcagcgatttgcggtcggattccagctgattgaaagccacggtgtccagggcgtagccgcgcgcggccagacgggcggctacggcgtcgatgtcgttgcgaagcagagtaatgtcgagcatggttattcctgttttttacttgtcgggatcttgctgggcgtcggcatccagccggcgcaaaaaggccagtttatcctgaatcttgctttccagtccgcgcggcaccgggcggtaccagcggatgtcctccatcccttcgggcaggtaagtttcgccggcggcgtaggcatggggttcatcatgggcgtaacggtaggcgtgcccgtaacccagctccttcatcaagcgagtgggggcattgcgcaagtgtaccggcaccgggcgcgatttgtcctgtttgacgaaggcgcgggcctcattatacgcgttgtatccggcattgctcttggcggccaccgccagatagatcaccgcttgtcccagcgcaagctcgccttccgggctgcccagcctctcgtaggtggcggcggcgtcgttggcgatctgcatcgcgcgcggatcggccaggccgatgtcctcccaggccatgcgcacgatgcggcgcgccaggtagcgcgcgtcggcgccgccgtccagcatgcggctgagccagtacagcgccgcatccggattggagccgcgcaccgatttgtgcagcgccgagatctggtcgtagaaggcgtcgccgcccttgtcgaagcggcgcgcgttcagcgtcagcacttcctccaggaaggcggcgtcgatgtcggccgcgccgcgcgcctgcgccgcggtgcgggtttgctccagcaggttcaggaagcggcgcgcgtcgccgtcggcatagccggtcagtgtggaaaccgcggcatcgtcgaaattcagcccgtccagcgcgtgttcgtgccgggcgcgcgccagcagctgcttcagctcgtcctcgctcaggctgttcagcacatacacctgggcgcgcgacagcagcgcggagttcacctcgaacgacgggttctcggtggtggcgccgatgaaggtgaccaggcccgattcgacaaagggcagaaacgcgtcctgctggcttttgttgaagcggtgcacctcgtcgacgaacagaatggtgtggcggccgtcgcgctgcagcaccgcgtgcgcgcgctccaccgcctcgcggatgtccttgacgccggcgaaaacggcggagagcgggatgaactcggcatcgaagctggcggcgagtatgcgcgccagcgtggttttgccgacgcctggcggcccccacagaatcatcgaatgcggcttgccggccgccaccgccaggcttagcggcttgcccggcccgatcaggtgctgctggccgatgacatcgtccagccgcgcggggcgcagcgcttcggcgagcggcttctggggttcggcggcgaacaggtcgggcatggcgggcttcgggcgggatattgcggagcaacagtataacagttggcggcaggcatgaaaaaagcgccagccaggcgttttgggcgtgcatgcttgcgggatggcggcaggctatggatctgggcgatttgagcgaagtattgttccggaaaaatcggtagaatttgggagtggttttttatctttaaaaatcagtggattgaaaatggtgtgttccccacgcgagtggggatgaaccgattgaacgcacttggggtgtggaaaatgagttgtgttccccacgcgagtggggatgaaccgcccccatggcagcgcacttccttgcagaataggtgttccccacgcgagtggggatgaaccgacgatggtggtctgcttgaggttgtggacctggtgttccccacgcgagtggggatgaaccgccgcctcctcctgatccagtccctaagggctagtgttccccacgcgagtggggatgaaccgcccccatggcagcgcacttccttgcagaataggtgttccccacgcgagtggggatgaaccgacgatggtggtctgcttgaggttgtggacctggtgttccccacgcgagtggggatgaaccgcccccatggcagcgcacttccttgcagaataggtgttccccacgcgagtggggatgaaccgataaaccgcgcttctgatgattgcggtcaggtgtgttccccacgcgagtggggatgaaccgtgggggtccggtgtcaggccgtaataggcggcgtgttccccacgcgagtggggatgaaccggtgccgatgccgcgcatgcacttcgccatcatgtgttccccacgcgagtggggatgaaccgccggcgatgtactggttctgcacgtcgaacccgtgttccccacgcgagtggggatgaaccggccgtggcgtcgccgccggttaccaccagggcgtgttccccacgcgagtggggatgaaccggcgagtggttttcaggcgaatggaatgcaggtgtgttccccacgcgagtggggatgaaccgtgggggtccggtgtcaggccgtaataggcggcgtgttccccacgcgagtggggatgaaccgtggctggtggggttggggggaaacaggccactgtgttccccacgcgcgtggggatgactcgcctgtatcgaatgccggcatgaaaaaagcgcccttggggcgcttttcggcatcacgagctgaagaaggcttaggcgcgcttcttgaattcgttggtgcgggtgtcgatttcgatcttttcgccggtgttgacgaaggccggaacctgtacttcgaaggtggtgcctaccaggcgggccggtttcagtaccttgcccgaggtgtcgccgcgcacggccggctcggtgtattccacttcgcggactacggtggtcggcagttctacggagatggccttgccatcgtagaaggtgacctggcagatgtcttccatgccgtcgacgatgaagttcagggtgtcgcccaggttgtcggcttccacttcgtactggttgaactcggtgtccatgaacacgtacatcgggtcggcgaagtaggagtaggtgcagtccttgcggtccagaaccaccacgtcgaacttgtcgtccgcgcggtatacggcttcgctgccggcgccggtcagcaggttcttcatcttcatcttgacgacggaagcgttgcggccggatttgctgaattcagccttttgcacgaccatcgggtcgctgcctaccatgaatacgttgccagcgcgcagttcttgtgcggttttcatgcttgtctaatcccaaactcttgattgaagccgggaaagattcccgacaaaacgcagtattctagccgatatcggcgataaagtgcagcagtctcacgacgagatcgcccggttgcagcagcgcctgttgccagtttgtcgcatgttgccgccaggcgggcaggcagggcgcggcgcggcgccaggccgcggcgatgtcgccgccctggttccacgccaggttgagcgcgcgcgcggcttgcgccgcctcggcgggcaggccttggcagtaatggtcgagaaaagcccgcagcttgtcgaggtgggcgtcgtcgtcctgcgggtagatgtgccaggccagcggccgcgccgcccattgcgcgcgcaccaggctgtcctcgccgcgcacgaaattgaaatcgcagccccacagcaggcggtcgtagtcgtcctggccgctcagcggcaggatatggactgtcagattgcccaggttggcgggttctcccggccgcaacgccttgccgaacacccgctccacatcggcctgcaccttgccggccggcaccaggcaggagaccggttgcgcgccatcggcccaggcccgcagcagcgccgtcgccgccgggttctcataggcgaacaggctgacgcgcagttcgccggcttgcggcggcggcaggccgcgccgccgccagtaggcttgttgcgccgccgggtcggcctgccaggcctcgcgcgcggcgatgaggccgtcttcgcagatcagcccgccgctggcggcgtcgaagccggggaagaagaaatgcttggtcagcggcagcctgggatggggcgagggcagcttgtgatggctgagagtccagtcctcggccgacaggtattccaggttgatccacgccggtttggccggcttcgccgccatcgcttcttcaaagctgtccggcagccggcaggcgaaggcctctaccaccacgtcgccggggacgacatcgggggggaagccggccagcggccactggcggatgtcgatgccggccagcgtctgttgcggcagcgccgggtccagccccggggcgatgcgcgcgaagctggccaggtcgtccacccacagccgcaccgccaggccgcgatcatgcgccagccggcgcgccagccgccaggcgacgccgatgtcgccgtagttgtcgatgacggtgcagaagatgtcccagtgttggcgtgtcatggctaggctaaagatgaaaaccgcgcgagcttatcacgggcggcgcggcaatatcaccggttgcgaatttttagcggccgggggagtcgatacaagcgacgatacatatataaaggtatgcctgtgcgcaagaaagcatggacatggctgctggcggcgctgccgctgccagcctgggcgggggtgttgttgcagaatggcttgtggcaggtggagctggagccggccacgctggccatcgcggcgaagccggcgggagcgatggcgcggcaactgtcgcaaggcgcggcgccgcatgcggtgtcggcgttgagccaggatggccaaacggcgcaatggcaatgggacgatggcaaatacagctggcgcgccagcttgcagggccgcgatctgcagctgacgctgacggcccgcgaggccggcaaggtggagctgttgcgccagcccgccgccgcgatggggcatggtttgctgctgccgctggccgagggcagttacatcccggcgggagacaaactgtggcaggactttctgcccggcttcgccggcgacggcctcaatacttcggaaaatctcagcctgccgctgtggggcatggattatggccatcacagcctgagctggctgctgctcaacccgttcaacaatgcgctggccatccgcgccgaaggcaaggggctggccctgtcgcttagccacgagttcaacgcgctcaatcagcagcagccgatgacgctgttgctgcacctgggcgaagccaacctcctgtccggcgcgcaacgctaccggcaatggctggaagacgaagggcgctaccagacgctggcggacaagatccgggcgcagcccgaagctgcgcggctgatcggcgccagccatgtttacctgtggggcaataacctgctggatgccgacgacgtggccgactggcccggctttgtgcagcggctgcgcggcggcggcgcgctggcgcgcaagctgcgcggccgtttcgacgccgaagcgcggcaactgctgcagcaagtcggctcccggcctgaccgttaccagaagaaaacgctgatcgaggccttcaaccaagcgctgaccgccgaggcccgcgccggctggctggggccgcagccggactgggaaggcatggccgagccttaccgccggctgcgcggacaggtggagcgcgacttcggcccggcgctggccgccgactccacgcgctggggcggcgggctgtcgcgcaaaaccgtggacgcgctggcggcggccggcctcaagcggctgtggctgggcgcggacaattgggaaggcggcctgtggcagccacaggcggtggcggccggcatcaaggcgggctacctgatggccgcctacgattcctacgaaaccgcgctgccgcccggtcagcatgtcgactggctcaccgcccagcaaggcgcggcagtctaccgcgactgcggcgtcacgctggccagcggcaagaagaaaaccggcttccagcaagccggctattacaccaatccggactgcgtgcgcgccacgctgcggcggcgcgccgaggccctgcaaaccgccgccggcttcaacagctggttcctggatgcctacgccaccggcatggtgtttgacgactacagcgccggccatcgcggcagccaggcgcaactggccgccggcaacgagcaaagcatgcgttggctggccgaccgcttcaagcagccggtaggctcggaaatgggcaacgccgccaccagcggcggcatcgccttcgctcacggcatgcaggtgccggtgctgggctggggcgacgcggacctgcagaaaaaccggcagtcgccgtatttcctcggccgctggttcccggctgaccagccggaaatcttcttccgccaggcgccgctgaagcaaccgtaccgcgacctctactacgcgccgcagtaccggctgccgctataccaggcggtgttccacggctccatcatcaccaccaaccactggctgtacgacaacctgaagttttccaacgcctacgccgacaatctgctggcgcagtggctgtacaacgtgccgccgctgttccacctgtccgccgccagcctcaaggccaggctgccgcagctacaatgcgccgaccgcgccttccgcccggttcacctgcaactggcgctgcaggcgctgaccggcttcgtctggctgaacgccgagcgcacggcgcagcaaacccgcttcgccgacggcagccgcctgagcgccaacttcggcgcgacggcggtgggcgagggcgatcaggcgctgccgccgcaaagcctgagggtggagctggctggccagccgccgcggctgctgcgggtggcggattgcggcgggggctgatgcgcggcgataatgccgttgtcgttttgcgggcgctgtgcctgcggtgacctccgccgcgctggccgcaatttgggtacggaattctcggtaggattgggatgcgcttttttgttttgaaaaatcagtgagttgaatttggtgtgttccccacgggcgtggggatgaaccgcgcgttctcagcggggtttcgacggatcgcaggtgttccccacgggcgtggggatgaaccggcgtgctaacaggagagggcctttatctagaggtgttccccacgggcgtggggatgaaccggcgcgaaatttaccgaggcggacgaggatcgggtgttccccacgggcgtggggatgaaccggcagcattcttcatacacctcccttggcggacgtgttccccacgggcgtggggatgaaccggcgatgcagccgtatgaaatcgccgtccgcacgtgttccccacgggcgtggggatgaaccgcgttacagtaacgctttctcgcctatgcttcggtgttccccacgggcgtggggatgaaccgccatgcttttcggcgacaccaaccaggagggcgtgttccccacgggcgtggggatgaaccgccatgcttttcggcgacaccaaccaggagggcgtgttccccacgggcgtggggatgaaccgccatgcttttcggcgacaccaaccaggagggcgtgttccccacgggcgtggggatgaaccgcntgaggcgggacaggcggttgtggctgtcccattccagccgggtgaggctgccgttgacgcgcttctccaccagattgccgcggctgtcgtagcggtagtggcggccggcgtactggctgagcaggttgccgagcaggctgtcgtcctgatggccgtcggcggccggggcgttgtccagcaggttgccggcggggtcgaagcggaagctttccacgcccttgggggtggcggcttccagcaggcggccgaccggatcatagcggtaactcagctggccgctacgattgtcggcggcgtcgtactggtactggcggctccactgcgtggcgcccatcagccgctggctggacaggcggccggccttgtcgtatgccagggtctgcttggtctgtcaggtcagcttgaacctgcggttggagagagtgtgcggccacggcagcctggcggtaaaattaaactccgtctcagaccaaataaaagcctaccaatccatactgacttggtaggctttacatgttgatcaaaaataatactagctaagcccatctagataatggcgagcctataaccaagtcattcagttcagggtccgacaaaatcccagcagattgaagaggagaaactatttcttcaagaatttcaaaatcctcttggcatcctgtgttttcaatcaaaacatcaatactttccttcacaagctgataatccctatttttatgtgcatgaattatcaggtccactatctcttctttgatacttttattttcagctctctctacatcatccgaatcaaaagatttatcataaaaatcatctaaattcttttttatcgcctcaagccgttcactcataaaaatactccttactctataacctcgtacgaacccttaggaatgccatttcttattaatacttcttggtctttagtggcaaaccgcttagcttttcctgtcaatccttggcccttgctaacatcaatgatgtcgcaatcaggtatctttgacagatctacttttattttacaattgcatttattataaaagtcgcttgttttttcacttttagttgttgaaataagctgtgtttgcagttttccattttccacatgttcctgagggctataactagcgctagggtcctttggggatatatcttgattttttaatgcacattgcttttgcttcggtgtaagtgcccggtaaaccgtccctgtaaactgtttccccgtcaaacctaacgggtccatccagactatgggatttagtgcataaccatagatattgattccgccttttagcccaatcggatcccgcgaaataaatcgcccgatctccggatcatagtagcgatggcggttgtagtgcagcccggactcgtcgtcatgatactgcccctggaagcggaacgggttgcggatgccggcttttgaggcggcgtcggcgatgacttcgcgcgcctggccccaagcctggtagtccatttccagcgccagcgcgccatgctcgtcggtcagcgcctgcggggtgcccaggtggtcggtgtggtagtagtacaccgccttgggggcctcgggttccggcgcngtgctggctccaggccggcaccttgacgccgcggatggcgtcggtgtgcacctgcgccagcggcacgaagctgtccggctcgaacaggtagtgcactgctgcttcgtcgcgggtttcgaaggccagcacgtcgccgtcccagccgtacagcgtggcctgtccctggctgatcttggcgatgcggcggcccagcgggtcgtaatggtagtcggtgcgctggccgcccggggcgatgaggcgggagaggcggttgtggctgtcccattccagcttggtcaggctgccgttgacgcgtttctccaccagattgccgcggctgtcgtagcggtagtggcggccggcgtactggctcagcaagttgcccatcaggctgttgtcctgatggccatcggcggcaggggcgttgtccagcagattgccggccgggtcgaaacggaagctttccacgcctttgggggtggcggcttccagcaagcgacctactggatcgtaacggtagttgagggcgccgctgcggctatcggcgatgccggtcagttggccggcggcatcgtactggtactgtcggttccactgcgtcgcgcccatcagccgctggctggacaggcggccggccttgtcgtagctctggtgctgttgcagcgcgttgcccagcacgcgctgggtttcgcggtgcagcttgtcgcgctccaggttgaagatgtcgcgctggccgaggctacgggctgaaatatggatagattggtggtatttttgtcattatttgaaaatccagaattctcttatacttatcaccgttattatgccgctatttttcttttgtattgggctatttattttttatgttatattgtgcaacccgagctacatcatcatcgttgtcattggttaaaatatttaataattcaattggcgtttttttattggctgcaatggattgacgcactgttggatctggatcttttgcaagcgcgtaaaacaaatctttagataactttcttttagtggcgacaaattgccttatttctggcccatatttgcagagctcttcaagaatttcaaggggcactgttttattgtgtgcgacccatttttgatactcagggaatcgattaataatatctatccatacgtgaataggagcttcctcctgtgcggatctgtcatattcttcttttttttcgctgtcacgtagcgaaataaattcctctgcagagctaatcattttaaatccttctgaactcgaatctcgaggctattatcatccatttcgatagtgacgaggccggcatcagtttgagcattaagtaccaacttgccaggaggctcaatgccctcaaaggaattgatagtaccaatctctagaataattctctttaactctctgggatgagcatctgatttggggagcgcataacatcggttgccaatttttaatccacttgcacttatatttctttggggcttgctgcgcactttcctttgaattaaagctctaggtaggagatttttatttcagagtatcgtgcctcgggatgtgcaatgatttaaaacgcggctagtcctctatttttttattaatttgttctctggaatttttatcgtatttatgacgtagtctgtggcagttgtgaagtcgtcaaattcttctctgatatatttaaaatataaatctgtggcatcttcatattttaatagataatcatcaaggccaatgtaatatttttgattcaatcttttaaagaagaattcgctaacagcttcgccgtttggatgtttgtatttttctgaaatccaaatcccagatttttggtgaactaagctttttagcttcattaaatcttcagtattcatttcttttttgaccttgaagggcagctgctcggtttttcaataaatatgtcagttttcttgccttctggggtgacgatatttatatgtggaatagttttgtgaggatgtccgtcaggtagtccttcatgaccatataaaatgccagttgctgggtttgtcttatagtccatgtgatacgaagctctgcctgttccattttgtctgttggctttaaaagcagccttgtcttttgctgtcttctcctcgcttttatctgcagcacctgccgatttttgagcgtcagggaaggctccaaacaaaatggcattggcttcttgatatgagcacgctgttacactttgccccgttttaatttgcgctatcttcttaaggatgctcgccgaactgagtccgtgagggtcgatccattcaattggatttgtgccatattcatatatgtttattccgccattgtgctttatcggatcgcgtgaaataaaccgtccgatctctggatcatagtagcgatggcggttgtagtgcagcccggactcgtcgtcatgatactgcccctggaagcggaacgggttgcggatgccggcttttgaggcggcgtcagcgatgatttcgcgcgcttcgccccaggctttgtagtccatttccagcgcgagcaggccttgctcgtcggtcagcgcttgcggggtgcccaggtggtcggtgtggtagtagtacaccgccttgggggcctcgggttccggcgcgggctggcgtagcgggtccttgtccgggtcataggggtggtgctggctccaggccggcaccttgacgccgcggatggcgtcggtgtgcacctgggccagcggcacgaagctgtccggctcgaacaggtagtgcaccgcttcttggtcgcgggtttcgaaggccagcacgtcgccgtcccagccgtacagcgtggcctgtccctggctgatcttggcgatgcggcggcccagcgggtcgtagtggtagtcggtgcgctggccgtccggggcgatgaggcgggagaggcggttgtggctgtcccattccagcttggtcaggctgccgttgacgcgtttctccaccaggttgccgcggctgtcgtagcggtagtggcggccggcgtactggctgagcaggttgccgagcaggctgtcgtcctgatggccgtcggcggccgcggcgttgtccagcaggttgccggcggggtcgaagcggaagctttccacgcccttgggggtggcggcttccagcaggcggccgaccggatcatagcggtaactcagctggccgctgcgattgtcggcgatgccgacgagttggccggcggcgtcgtactggtactgtcggctccactgcgtgacgcccatcagccgctggctggacagacggccggccttgtcgtaggccagggtctgttgcagcgcattgcccagcacgcgctgggtttcgcggtgcagcttgtcgcgctcctggttgaagatgtcgcgttggccgaatagcaggccgtggacgtggccgctgccgtagttgagcacgtccacgcggtggccgtccgggcggacggtggcgatgcggttacctagcttgtcgtactcatactgtctggagaaatggggtaactcatcgagagaaattcgatcgcaggaagaatttctctcgatgagatttatttcttaagtgaatggtcattatattggagcgtattttcggtcatcagtttcaatatcttcttgactgttaagaatgacattctccacatcaagaaaattgatcccctttatttcttgcttctccatttcattttttagttcttcagagacaattagactgaattgatttggtgaaacatcaaaaacatcaaacaagtcaagatccaagtctgatttgaatcttatagattcaaacatttcaccaaactctcctgcaaccttgctacgattcatgtctataatattttttttgcttattctttttgtttttccaacaaaatatctcttgcctggaattaattttcctgaattatctaggtaagatactggagctatttctgaaaagctggttttgaatgaagctaaaatattaacgactcgctcgcttaaaacatagaagtatggggatccacgcctgatgtcgtattcataggtcgaattttcgacaatcaatgataaattatcgggaaatggcggaagccctcccccaaatttctttggaccagcataccaaggcaatttcccatatccgcttttataagagttactattgaattcgcttaagaggtatgcgtaaaagaagccagatgggcaacctggctcttctttcatagccatgatgtagaactttttcataccttcctcaatttaaacgttcagggcattgtccagatgtcaaaggagttcgcatttttttcttcgtctttcttgtattcttccagttctcattcttgcatctgctgccgaaatattacctgaatcaaaattgaatctaacctgctcaacttcggctgaaactgagtcggagtaatttttatgtgatccattgtggtagtattttctattcatggcattagcccctgacgcgctatcaggcatcaatactccatttgatctatgatcgcgaatcccagacataccaatgttgtcgaagaactcttcatttttattccaagcctcttgcgggatgatgtgttgtgcttgctttttatcccctttaatacccgccaagctcttgtcgagagcacaactgcctcccttcttttttagcccccatgggtctagccactctattggattaggtgcgtaactaaaaagattaatgcccccaaatagtccaatcggatcccgcgaaataaaccgcccgatttccggatcatagtagcgatgacggttatagtgcagcccggactcatcgtcatgatactgtccctggaagcggaaggggttgcggatgccggcttttgaggcggcgtcggcgatgacttcgcgcgcttcgccccaggctttgtagtccatttccagcgcgagcaggccttgctcgtcggtcagcgcttgcggggtgcccaggtggtcgttgtggtagtagtagaccgccttcggcgcttgtggctccggaccggcctgacgcagcgggtccttgtccgggtcgtaggggggggggctggctccaggccggcaccttgacgccgcggatggcgtcggtgtccacctgggccagcgggcacaaagctgtccggctcgaacaggtaatgcaccgcttcttcatcgcgggtttcgaaggccagcacgtcgccgttccagccgtagagtgtggtctggctaaccaaagttttaattgccctgaagcctaagcagaaacattttctaaatataagaggcgcttgaaggataggaggtgatagtgaaaataaccgctcttaaagtgattccgcaagcttccatttctttccatcagtagagaaatgtaatttttcaatcaaccattttgagttgttttcttgaagagtatatctgaaaaaattttcaaatccactgttttgttttgttatgacgtaattgtgtgtagacgatatttcttcaataatggtttgttcgtaagccggggggcgacccaccgccatagtagttaaagcggcgtcggcaattttattttgctcgccatctttgacatacttctcaaatatgatgcgcagtctttctcttgccatcttttttgatttttcacgctcagtgggatcagttttataagcttcacttctctgttctttgtagaagcttatttcccagtcgagcatctcttttaaatattgtcctatggtttcttggggggtcattttttttctccgcaacaacattttaaaggattgtcaaagactctcgtagtggttttgccatttattcttgtttggtataaaacagaatgaggcctagtggagcccttgtcatactgtggaacgactctgacaattacattgtcaccagctttaactttttctgcaatttgagcttcgtgagttctatattggccacggttaatgcccagagcttgggggaatactccatcatcaccaccagaacctcctagtctattcgcaatggcatggccagcatcatcgtgcgggcaacctaaactacgggcgaatgctctagaggaggtgctagtctttgtgcctgtattcaaatcctcgggtctaattttagcagtggcacttctaatttcaccgttggggccgtatttatacttgtacttggcacctgctgcccacagacctaggggatcaacccattgtattgagttaggtgcatagttatgtgtatttatccctcccatcaacccaatcggatcccgcgaaataaaccgtcctatctcaggatcatagtagcgatggcggttgtagtgcagcccggactcgtcatcatgatactgcccctggaagcggaagcggaaggggttgcggatgccggcttttgaggcggcatcggcgatcacttcgcgcgcctggccccaggcctggtagtccatttccagcgcaagctggccttgctcgtcggtcagcgcttgcggggtgcccaggtggtcggtgtggtagtagtacaccgccttcggcgtttgcggttccggtgcggcctggcgcagcgggtccttgtccgggtcgtaggggtggtgctggctccaggccggcaccttgacgccgcgaatggcgtcggtgtgtacctgggccagcggcacgaagctgtccggctcgaacaggtagtgcaccgcttcttggtcgcgggtttcgaaggccagcacgtcgccgtcccagccgtacagcgtagcctggccctggctgatcttggcgatgcggcggcccagcgggtcgtagtggtagtcggtgcgctggccgtccggtgcgatgaggcgggacaggcggttgtggctgtcccattccaatttggtgaggctgccgttgacgcgtttctccaccagattgccgcggctgtcgtagcggtagtggcggccggcgtactggctgagcaggttgcccatcaggctgttgtcctgatggccgtcggaggccggggcgttgtccagcaggttgccggcggggtcgaagcggaagctttccacgcccttgggggtggcggcttccagcaagcggccgaccggatcatagcggtaactcagctggccgctgcgattgtcggcgatgccgacgagttggccggcggcgtcgtactggtactggcggctccactgcgtggcgcccatcagccgctggctggacaggcggccggccttgtcgtaggccagggtctgctgcagcgcattgcccagcacgcgctgggtttcgcggtgcagcttgtcacgctccaggttgaagatgtcgcgttggccgaacagcaggccgtggacgtggccgctgccgtaattgagcacgtccacgcggtggccgtccgggcggatggtggcgatgcggttgcccagcttgtcgtactcatgctgccagcggtaggtttccttgaccccggcgacgtggtagccgtggtgctcctcgacgacgttgccgactgggtcgtacacccagcgcaggctggcatagcggttcttggcctggaacaggcggccggccgggtcgtagccgaagctttccttgctgttcggcgcgctgcgctcgatcaggcggccggcgcggtcgtagcggtaatcggtggtgacgtcgccttccacctgctgcgccaggcggccggcgttgtcgtagacatagcgggtggcgctgccgtcgaagccggtttcggctgtcaggcggccgccgtcgtcgtagtcgaagcggtagtagcggtggttctcgttgcgcagcgcggtgaggcggcccagcttgtcgtactggtagcccaggctgtggccgttggcgtcggtgcgcttttgcagccggccggccttgtcgtattcgtagtgggtgccgcggcccagcgggtcggtgattttcagcaggcgggcttcggcgtcatgctccagctgggtggcttggccgtccggctggacgatggcctgtagcgtgccgttggcggcgtactgatagcgggtggcgttgcccatcgcatcgacgatcagcagcgggcggccgcgttcgtcgtactgccactgggtggcgctgccggaacagtcggtatagctttccagcaggccgtccggacgataggcgatcttcttggcgccgcccttggcgtcggtgatggccaccggcaggccttgctcgttgtacgcgtacttggtcttgtggccgagcgggtcggtttcctctatcagctggcccatgtcgtcgtaggcgcgcagccatttctcgcccatcgggtcaatgatttcgactagattgtcctgttcgtcgtaggcgaagcgcacttcgctgccgtcggcgcgctcgtgccagatcaggttgccgttggcgtcgtagtcatagctgtcttgcgtgccgtccgggcgaatatggctgagcagcttcttgtcgtcatcgaattcaaaccactcttctttgtggtccggatagacgatgcggtagttgtagcctttgtcgtcgaaatagtattcggtggtgcggccataggcatcagtgacataggtgagatcgatattctcatcccaggccaggcgcacgtccaggctgccgtcgtcggcgtattcgcgaatggctcgggcgtccagatgcgtgccatcccattccagcgtgatgccgcggccggtgcggtcggtgtagcgggtgatcaggtgatgctggtactggtagctccagctttcgccgttttcatcggtggcggccagcaggtcgccggcatcgccgcccagctgcgggatatcgctgtaacggtattcggccagcgtgcgttgcggcaggccggtttccagattctgcagggtaacgcgggtgacgcggccaatggcgtcgtgattcaggtccactgcgtagccggcgctgctgaccagctggctgaggcggccatcgcggaagttcatcgcaatgctgttgccggcgcggtccttgatcagcgccagtcggaagctgtcgccgtggcgctcgtacagctggatcaagtcatggccaaaggtctgcgacagcagggtgtcggataggcgggtgagcgtaaagccctcgatgccgtccttgtgcgactcgccttccggcagcagcggatagtccagcgtgcggccgctgtcgtcgtggaatttcagctgcccgccttcaatgtcgaagcgggcggcgtaggcaagactccagcgcgcgccgaactcgcctttttgatcgttgccgccgaagttggaacgatattgccgtgtccaaacaataggaagaacacccggaaggctgaagtcggtgtgttgtagcgactcgtcgccaaaagcgtacccgatggaggcctgggtgctagcgcacgcacattttggccctggtttggcgagctgcttgagcttggcggcaacttccttcacggtctgttcgacctttttcttggcggtattcaccgccttggtcgccaccgccgccgcttttttcggcaggtgattgaggaaggctttcagcagtttgtccagcaacggcttcaggtggctgctgtacatcttcatcagcatgtccaccagcatgcccgcccatttggccatggccgcgcccaggcgctgcatcaggcgcgcggaaactgtgcctttcaggatggagtcgatctgcttggcggcggccaccgtcatgccggcggccgcttcggtgccggcatcggcagcggcctggttcagcgaatgcaggtgggcgctgaccgtgccccaaaaaccttggtcattggttttattgaggttgtaccggacgggcgcatgcttgacgttcttttgcacataggcgccgaacttgccggtgcccaggctggtcagcagttcgcccatgccggcgatgatggtggcgcctttggcgccgcagactttcagctcgttctggatcttgccgtctacatactttacccattccgccggcgagttgcggtaactggccggcagcatggtcaccagcttggccgccaggcccgcttcgatctcgcccttggcccagtctttgccggcgcggcgcaggctggtggcgcacaacttaagcgtgggccgcgcgcccatcttgaacaggccgccggccgcggggatcacgccgatcaggtccacgcccaggaacagccagtcgaagacatcgacctcctgattggcgcgggatttgttggacatgtcgacgatgtcgacgatgacgtcgccgatggaaatcaggttgcccaccaccggcactgcggacgcgatggttttcaggctctccaccgacagatggccgtcgctgatgctgcgcagccatttatcgaagtcttggccggtttgctgcagcgcctgggctgcggcttgaggcgtggcgggaataacggctacggggcgtgcgagggctgcggtcgtcatgatggcgagtatcttttacagtattttcttgagcagattggctgcgttcgggacggtggcggcggaagaagccagttgcttcacatcgcgcgcctgctgcagcatggcctgcgcctggccggccacttgcttggcctggtccagcgtattcttggcttgggacagttggccggcggccgcggcgacgccgggcggcaaggtcttgcccaccaggctggagagctggctcatcgcctgcttcttcaccgcctctccgcccaccagctgtttcaccgcttcttccggctgtggcacaaaggggaagatgtcggccttgtccttgttcggccggcccaggaagtcgacctgggcggggcccaccggcaagccgtgcaccatcgccttgccggcctcgtccagcacgcccttgtgtttgacgcccagcgcgtcggtgacgacgaacttgccctggttcatcgagacgccgttggcgaactcgtggatgacctgcagattgccggtgccgggcttggcgaatgccggggtgggggtgctgaggctggccgggccgctcaggctatggctggcgcccttgacgctcacttcgctggggcagtgtatttcgatattgccgccggcgatgcggatgtagccgccgccgctggtgagcagcacttcctggctggcggcgatctgcaccttgcccttggccgaggtgatggtcagctccttatccgccgtcagctccatcgcgtcgctttgcgcctgtacctgtaccttccccttcgccgcgatcagcttcagcgccaccttgtccttcacccctgccacgaacaggctgaggtgctggccgacattgtggatccagcgccggccggtggtgtggttggcgtcgcgctgggcgatcaggttcaggttttgcccagcggagacggtctggctctgctcggtcagggcggcgatgccggctgggccggacagcaccagcagcggctgctggccggcttggtcctgggcggttttgccgtctttgtcggtgttgctgccggcttcccaggccttcagcgcgtcggcgtggtgttgcaggtggccttgggatttcttgccggctttggcgttgtccgggccgatttcgtcgggcccggtttccatgctgtcggccagttggccggcggcggtttcggccagcgcttgggagaggctgagggcggcgtcgagctggcattgggcgtgctcgcgcgccagctgtttgccggatgcgccgttttgcgcttcggtggacagcagcaggccgtgggcggcgcggatggcgccgtgctggtcggttctgagttcgaagccgtcgccgcgcggctgggctttgccgttgcttcttgggtgggcgaggtagccttggttgagctgggtcttgcccgcttcgctggatagcttggcgcgcacttcgccgggggtgtcgtcgaacaagagttcgttgtagccgccgccctggtgttccttgctcttgatgccggacagggtcttgttggcggggagcgtgccggcgccgctgaagtcgggcgtcgggtggctgccgttgtacaagacgccggtgatgacggggcggtcgatgtcgccttcgatgaagtcgaccagcacttcctggccgatgcgcgggatgaactggtggccccagccggcgccggccgagggcatggcgacgcgcagccagcaggaggatttgtcgtcgagaccggcgccgatggtggggtgttcgtccggccgctgccagtggaattgcaccttgatgcggccctgggcgtcggtgtggacttcttcgccggcggggccgaccacggtggcggtctgcacgccgaggctggtgggcttggccgattcggtgccggcgtaggccggggtcagcgggatgccgcggcgctgggcctggatctggctggcgaagggttgcccgctgtcgctgtcggccagcaggctgggggcgagggcgcgcagttgctgnagtgttccccacgcccgtggggatgaaccggggccggcgctgtggcgggggtgacgctgaccgtgttccccacgcccgtggggatgaaccggtcagtgcgccgtcgaacgggctgaaccaggcgtgttccccacgcccgtggggatgaaccgctatcgcacgcgcctggtgcggttgacctgtcgtgttccccacgcccgtggggatgaaccgcgccgcacgccgtcgccgtctacgtcctggacgtgttccccacgcccgtggggatgaaccggacagattgccgtagcaaacatcctcttgaccgtgttccccacgcccgtggggatgaaccgcgccgcacgccgtcgccgtctacgtcctggacgtgttccccacgcccgtggggatgaaccgcagactgccagcctggcgaaaccggtctgagagtgttccccacgcccgtggggatgaaccgcgcccggcgggttcgagctcgatgccgatgcggtgttccccacgcccgtggggatgaaccgcagactgccagcctggcgaaaccggtctgagagtgttccccacgcccgtggggatgaaccgaaagacatcgagcgtttggctcaaacggtgctgtgttccccacgcccgtggggatgaaccgtcttcccatccaaccaacagatacgcgccggagtgttccccacgcccgtggtgacggtcggactaaaattcggcaacttacgctttgcactgcgtgtcccgctctccgcgtaccttctacctactgttgcatctcgcttagatattgcgtcagccgcagcgtcaggctggcgcgggcggcgttggctggccataccgcgtacacccccagagcttccacctgccactcgggctcgacttcgctcagcctgccggctgcgatgtcgtccgtcgccaggaaggccggcggggtggccaggccgcagccggcgatggccagctggcagacggcatccaggctgttggcgcggatggctggctggatggagaagctgtgcgcctcgccggccgcgtctagcagggttttgcggtcgggccgcatgcgtatgcccagccagggccagtcggccagctcttgcgggtggcggggcgcggggcgcgccgacagcaaggcgggcgcggccaccagcaggcgcggcatgtcgaacaggcggcgcgattttagcgcgctgtccggcaattcgccgatgcggatggccaggtcgatgccgtcgcgcaccaggtcgcgcttctcgtcgctgtagtccaacgccagctccactttgggatggcggcgggcaaagccggccagccgggcggtaagcggcgaacgggcgaaaaaggcgggcagggtgaggctgagccgtccggtcggttcggtggcgcggccggccagggcgtcaagcccgctttccgccgcccgcagcatggcctgggcgtgttggaacagcgtttcgccgtccgccgtcagcgacagccggcgggtgctgcggtacagcagcgccgcccccagccggctttccagctgcgacacatggtggctgaccaccgacggcgacagctgcaaggcccgggcggcggcgcggaaggagccggtttcaacggttttggcgaataccgccaatgcgcgcaattcttctatcattgttctattttttcgatcagttagtttcaattgctctgaattgtagatttcctggccttggcgcacagtggcaagacttgaatcatcgcccggattgctgaccttcgccctttcgcagggcagggggcgggatgcgaatcggcaggcgcggaatgggccgcagccgccgcgccttcccgcttcgcggtgtcggcagtctggcaagacctggtcattgcctggagagaaaacatggaagaacgccgctgcgccatcatcgtcgaccccgatctgcccgccggcatcgccgcgaataccgccgccgtgctggcgatgacgctgggccgccgccacccggagctggtgggagacgacctggccgacgccgctggcagcgtgcggttgggcatcgtcacgacgccaattccggtgctgcaaggcggcgcggcgttgctgcgcgccttgcgggcgcaggcgctggaggccggattgacggtggtggagttgacggacgccacccgcagcacccgcagttatcaggagtacgccgccgccttgcgcggcacgcccgagccagacttgcgttaccaaggcctggcgctgtgcggcccggctaagcaggtgcggcggctgaccggcagcctgggcctgttgcgctgaggaggagggagaatggtctggagctttatcgccgccaccgccttgatcacgctgttgccggggccgtcgatgctggtgatcgtggcctgcgcgctgggccagggctggcgcgccggggcggccgccaccggcggcgtggtgctggccgacgccatcttgatggccatcgcgctgagcggcgtgggcgcgctggcgcaggcttcgcccttggcgctgctggggctgaagtggctgggcgcggcgtatttgacgtatttgggcgcgagcgtgttgcgggctggaaataaaggggcggcggcggaagcgagcggccgatcgggcggcgcttttcgccgcggattggcggcgacgctgcccaatcccaagatcatcgcctttttgattatctactttccgcaattcatccagccggggcgcgatacggccggccagctgctgctgctggggccgctgtttttgctgacggtgggcgcggtgtttctgctgtgcatggcggcggcgctgacggtgggccgcgccatgccgcgcggccgggctggccggctcagtcgggcgtgcggctgctgcctgatcgcctgcggcttgtattcggcgctggcttgaggcttaggccagcgcgcgctccagccagcgccacagttcgggcgcggcgaagtcggcgatgacggctgccgcgccggcgtccagcagtttttgcggcggcagcgcgccggcgatgccatagctgtggatgccggcggcgcaggccgcgcgcatgccggacggcgaatcctcgaaggcgcaggcgcgctcggcgcggccgcccaggcgggccaggccggtctggtaaggcagcgggtgcggcttgccgtgggccaattcgtcgcctatcaccagcgcgtctatccgctgcgccaggcccagcccgcccagcatcagctcggcattggcgcgcggcgcgttggtgaccacggcgatgccgacgccatggcgttccgcccagtcgaacagttcccgcgcgcccggcgtggggacgagccgggtgacggaatcgcggaacaactgctccttgcgcgcggccagggccaggtgttgggcgggctggtcgggaaacagccgggccatgatggcttcgttggcggcgccgacgatgtggtgcaggaaggtgtcgtgatccagcgcgcggccgtgctcggccatcagggtgcggaaggcgtcgaaatgcaggtcgtcggtatgggtcagggtgccgtccaggtcgaacagcaggctgaaatcggctttggctttcacggctgggcctttgttgtcaaacgcatcggccgttttcttaactgtaccgatgcgtatggttttgcggagaggccatgatggcactctcgaaacaaaaacgccaccgcgagggtggcgtcttgcgtcatgcggcagggttcaggcggcgtcgtccacccaacggatggcctggctgggcaccaccttgctctccaccttgatctggatggccaggccgccgcaggaggtttcgcggtacttggcgtccatgtccttgccggtttcgtacatggcggcgatcaccttgtccagcgacaccttggggctgctgacgcggtgcatcgccatgcgggcggcgttgatcgccttgaccgcggcgatggcgttgcgctcgatgcagggaatctgcacctggccgcccaccgggtcgcaggtcaggcccaggttgtgctccatggcgatttcggccgccatgcacacctgggacgggctgccgcccatcagctcggtcaggccggcggcggccatggaacaagcgacgccgacctcgccctggcagcccacttcggcgccggagatcgacgcattcagcttgaacaggcagccgatggcgccggaggacaggaagaagcgcagacagctgtcgtcgtccagcggctggatgaagtggttgtagtaggccagcaccgccggcacgatgccgcaggcgccgttggtgggcgcggtcaccacgcggccgccggcggcgttttcttccgacatcgccatcgcgtacatgtttacccagtccatcacgctcatcgggtctttggccacggtcagcgagctggtcagcatccggtgcagcgccggcgcgcggcgcggaatgcgcatcgggccgggcaggttgccttcggtgcgcatgccgcgctctatgctgcccttcatcacttcccacacgcggcggaagtgagcctgggtgtctttcacgtcatggaaggccttctcgttttccatcaccagcgcggcgatggacaggccggtttcttcgcacatgtcgatcaactgctgggcggtgacgaagtggtatggcaccggggtgtcgctgcagctggattgattgaagtgctcctcgtcgacgatgaagccgccgccgatcgagtaataggttttggtcaggactttttcgtcgccgacgaaggcgtggatctgcatgccgttttcgtgcagcggcaggttggcggtgtgaaagtccatgccgaaggccacgcgctggtgggtgcggcccagcgtcaactggccggtttgctcgacgtcggccagcaggctggcggagttgtccgggtcgacggtgtcgggcaggttgccggcgaggccgaggatgatggcctggtcggtgcagtggcccttgccggtgagggccaaggagccgtagcagtccacgtggacgcggttcacttggttgaacttgccggtttccttgagcgcgccgaggaactggtggccggccttcatcgggccgacggtgtgggagctggaggggcctacgccgattttgtagatgtcgctcatgctgaacatgatgctgcctctttgaagcgggtgcggcgggaaggcaggcgcgatccgcggcctgtcaggctgccgacacgtgagtgggggcgattccggagggcccggcgcggccgggcctcctgatggctgtgttagggtccgcgggcgcccctgctggcccggcaaggcggtatcgccgggcggagaggagcgggcgcggcccgctggcttacgatcaggcgatcagatcgtagaagatggcggagatggcgatcaggccgatcagcgtcacgaagatgttgctggcggcgccggagtatttcttcatcgccggcactttctggatcgcgtacatcggcatcaggaacagcagcatcgcgatcaccgggccgcccagggtttcgatcatgcccaggatggacgggttgatggtggcgatgatccagcaggtcacgatcatgaagatggcggtgtagcggtccagcttcgacgattcgatggtcttgccgctttggcgcagctgcttgatcaccaggccgttgaagccttccttcgcgcccaggtagtggcccaggaaggacttgctgatggcgaccatggcgatgataggcgctacccattccatcactgggttctggaagtggttggccaggtaggacaggatggagatgttctgggccttggcggcggccaggtcggccgggctcaggctgaacacgcagctgaacacgaagaacatcacggtcagcaccatcatggtgtgggcgcggatcagcacgcggctggaagattgctcggcgtcatcgccgtgcagcttgcgctggtcgacggagaaggacgagatgatgggcgagtggttgaacgagaacaccatcaccgggatggccagccacagcgtcttgtagaaggcgccgctggacacggcgtcgcccaggctgccggcgtggcggatggcggtgtcgctccattgcgggatcaggtacagcgccaacatcatcagcaccaccacgaacggatacaccagaatgctcatcgccttgacgatcatctggccgcccaggcgcacgatggacatcaggcccaaaatcagcgccagcgagaacaccgcgcgggtggcgatgccggtgcccacttcgatgtgcagctggttgttcaggaaggacagcaccgtgttggtgatggccacgctgtacatcagcaggatcgggtagatggcgaagaagtacagcagggtgatgatcttgccggcgccggcgccgaagtgctcttccaccacttcggtgatgtccgcgccttccttgctgccggacagcacgaagcgggtcaggccgcggtgcgcgaagaaggtcagcggcagggccaggatggccatcagcatcagcggccacaggccgccgatgccggcgttgatcggcaggaacaggacgccggcgccgatggcggtgccgtacaggccgagcatccaggtggtgtcgtgcttggtccagccggaggagccggatcgcggggcggttgaagcaatggcttgagacatgatgtggtgccttctaaagacaagtttttgcaattaccgagtcgatttcccgcagtcgtttcaggctgccggccatcgagagaagcttggtgcttgccggggagcgattgagcggatcgcgctgtgtccggctgacttgctgctcatcgtaagtgctttgtaattaacaaggtacacatttaagaacatcagttgattctaatcaagttaaatttgtatctaaacgaacaagcgaacatcgcttgcggccggcgtggatgctggttttaaaatgctaaaaagataaattggcaattttgtttcaaaaaccagtaattaagttttattaatcttggtttttggcattaaattttaatgaaattccttgttgtgaaaatttacagccgtgatggtggggttcggcgttgaggcattgcttcgagtttttgctcgattttggcgcggggcggctggaagagagcggggcaggctggcttcgacgatttcggcatggccgcatccggcggcgcggatccgcgtccaaatggctggcgattgtgaatggattgtatcttgatgaaattaaaagactattatctgacggattcggatgggggggcggcgcgctgggttccaggcgagcggaacctggcagggcgatttcgttgttggaaattgttcggagtaggattgaatatgaagaatactggctatttaatgttcgaatgtgaaaatattttgtttcaaatgaacatttaatgtttcgtatgcgaattttccgtgggttgcggggagaaatgagccgaaagtggtcacgccgccgctgccgccggcaagccaatgaaaacgacggcgccggcgttttcgcggcggccgcatggcggcgtttcgcccggcggcgggcggattgggcggcatgggcgcggggaagtcgtggcggctggcgggtttatccagaatgggaaggcgggcttgtgttgatggttatcaaacacgaatttacggaaacgaacatagaattttcctaatttgcaaggaatgcgaatggctgccgccagatgggaaccggttcgccccttgcctgtcgcttttccatattgatagagacaaacgccatgagtcattcctccactctcgcctacgtggccgacgaggccgccagcaagcaacaggcgctgcgcagcgagccgggtcgctacctcctcagcgccgcgatggccggcgcgctgatcgccgtggtgctggcggtcagcctgaagctgggccaggtgttcttcgccgccggcgactccggctattacatcgccaccgccggctttttcggcgtggcgctggtcagcatcatcgtctgcaaggtggagctgttcaccagcaatgtgatgtacttcaccgtcggcgcgctcagcggccgctgccggctgtgctatctgctgcgcagctgggcgatggtctatctgggcaatctggccggcgtgctgttgttcgtcgccgtgctggcgggagcgggcggcatgggcgcgctgccggccgaccacctgctgttcaatgtggtgcagcacaaggtgcatgccccggcgatggagatcttctggaaaggcgtgctgtgcaattggatcatctgcctggcggtatgggtgccgatgcggctggccaacgaggcggcgcgcatcctggtgatcatgctgctggtgttcgtgttcttcttctccggtttcgagcacagcatcgccaatatggcctttttcgcgctggcgaagatgcagggcatggccgggttggcgtggagcgacatcctgcacaatatgctgccggccacgctgggcaatatcgtcggcggcgccatcggcgtcggcctggtggtgttccggctggaacgtcacaccttgcgggcggtctgatgccttagggaagcatccctgccggtggatggtatgtggatgttcggtttcgaatgtagtcggcgcggtacatggcgtactgcgccgactttgctataaaccattgagaaaataaggatattggacgcatccggcatgttgcgccgcgggatcgaaaccgcgccgaaagcgatggctgacttgactaagatcaagcgaaattttcgaattcgaatgtacgatgtgttcaatatctaacacttactggatcagccaagaaggaggcaccagatggacgccatcactcaaaatgctacccaagccaacccgtggcgcgatttcgccgccggcgactggcagagcaaggtcgatgtccgcaacttcatccagctgaactatcagccgtacgaaggcgacgacagcttcctggctggcgcgaccgatcgcaccaagaaactgtgggacgcgctgggcgagctgctgaagcaggaacgcgccaagggcgtgctggacgtgtccgccgaccgcggctcctccatcaccgcgcacgacgccggctacatcgaccaggccaatgaagtgatcgtcggcctgcagaccgacgccccgctgaagcgcgccatcatgccgaacggcggcctgcgcatggtcgagaacggcctggaagctttcggcttcaagctggacccgatgatcaaggaagtgtgggaaaagtatcgcaagagccacaaccagggcgtgttcgatgtctacaccccggaaatcatggcttgccgcaagtccggcgtgatcaccggcctgccggacgcctacggccgcggccgcatcatcggcgactaccgccgcgtggccctgtacggcaccgacttcctgcgcgccgagcgccagcaagtgttccatgaactggacaacgccaccttcaccgacgatgtgatgcgccagcgcgaagagctgtccgagcaattccgcgcgctggacgaattgaagcagatggccgccaagtacggctacgacatcagccgcccggccgccaatgcccgcgaagcggtgcagtgggtgtacttcgcctacctggccgccgtcaaggaacagaacggcgccgccatgtccttcggccgcgtgtccaccttcctggacgtctacatcgagcgcgacatcgccgccggcgcgctgactgaggcgcaagctcaggaaatgatcgacgacctggtgatcaagctgcgcatcgtccgcttcctgcgcacgccggaatacgatcagctgttctccggcgacccgacctgggtgaccgaatccatcggcggcatgggccaagacggccgcaccctggtcaccaagaacagcttccgcttcctgaacaccctgtacaacctgggcccggcgccggaaccgaacctgaccgtgctgtggtcggtgaaattcccgcaaggcttcaagaacttctgcgccaaggtgtccatcgataccagcgccatccagtacgaaaacgacgatctgatgctgccttactggggcgacgactacggcatcgcctgctgcgtgtcggcgatgaagatcggcaagcagatgcagttcttcggcgcccgcgccaacctggccaaggccatgctgtacgcgatcaacggcggccgcgacgagaaatccggcgcgctggtggctcacggtttcgagcctatcaccagcgacgtgctgacctacgacgagctgatgcccaagttcgagaagatgatggactggctggccgccacctatgtcaaggcgctgaactgcatccactacatgcacgacaagtacgcctacgagcgcatcgaaatggcgctgcacgaccgcgacatcgtccgcaccatggcttgcggcatcgccggcctgtcggtggccgccgactcgctgtccgcggtcaagttcgccaaggtccacatcatccgcaatgaagacggcctggccgtcgactacaagatcgagggcgactacccggcttacggcaacaacgacgatcgcgtcgacgacatcgcggtgtggctgacccagtccttcatggacaagatcaaggcccagccgtacttctaccgcgattccaagccgacccagtcggtgctgaccatcacctccaacgtggtgtacggcaagaagaccggcaacaccccggacggccgccgcgccggcgaaccgttctccccgggcgccaacccgatgaacggccgcgacgtgaagggcttcgtcgccgcgggcgcctcggtggccaagctgccgtacgattcggcgctggacggcatcagctggaccgcttcggccacgcctgacgcgctgggccacaccgccgaagagcgcatcctgaacctggccaactgcctggacggcttctgctccgcgcacccgaccgagttcagcagcgccaactgcacgccgttcgactgcgaaggcgagcgccacatcgccggcggcggcttccatgtcaacgtcaacgtgttcaagcgcgaaaccctgctggacgcgatggagcacccggaactgtacccgcagctgaccatccgcgtgtcgggctacgccgtgaacttcatcaagctgacccgcgagcagcagatggacgtgatcaaccgcaccttccacggcaagatgtaagacgcgtagggcgggcaggctcttgggcttgcccgcgcggaaacaccatcgcatcaatggcggggcggtccggaaggaaagccccgctttttcacaagattcaccggagaaacggcatgatcccacctattgccgcagatcacaccgaagcatgcgttaaggccgaaaccataggctatctgcactccaccgaaagcggcgccggcgtcgacggccccggcatgcgtttcgtgtttttcacctcgggctgtcagttccgctgcctgtactgccacaatccggatacctggaagctgcacaatggccgccaggtgacggtggagcaggcgctgtccgaagtcgcttcctacgcccgtttcctcaagttcgccggcggcgtcaccatctccggcggcgaaccgctgatgcagcacgagttcgtcggcgagttgttccacgcgatcaagcagcgcttcggcctgcacaccgcgctggacacccagggtttcctgcacgagcgggtgccggatgaatggttcgacgatgtcgacctggtgatgctggacatcaagcactccgatccggaaaagtatctggccctcaccggccagcccttgcagccgacgctggacttcgcccagcgtttgcagcggctgggcaagaaaatgtggatacgctacgtgctggtgcctggcctgaccgacggcgacgccgacatcgaacggctggctgatttcgtcgccgcgctgggcgaggtggtggaacgagtggaagtgctgcctttccaccagttgggcaaggacaaatgggcgcagctggggatggagtaccagctgaacgacacgccgattcccaccgccgggcaagtggcgcatgcgcgcgcgctgttcgccagccgcggcatgaaggtaacctgagccgggctggaccgcgccgccatcgacgcatgccgccggcctcggatggggccggcggcattcgcgttatggcggccaggcatgtcccgccgcggcgcaggtcattcaataagcaaaggcaagcgatggatatcgttctggaaatctgcgccggctcgccggcgtcggcgctggcggcgcaggaaggcggcgcgcagcgggtggagttgtgcgacaacctgctggaaggcggcaccacgccgtcctacggcgcgttggcgctggcgcgcgaccggctggcgatcggcctgcacgcgctgatccggccgcgcggcggcgattttctgtattcggaactggaattcgaacagatggcgcgcgacatcgagctgtgccgccggctgggcgtggacggcgtggcgttgggcctgctcaccgccgacggcgatgtcgacgtcgagcggacccggcaactggccggcctggccgggcctctggcggtgacctttcaccgcgctttcgacatggcgcgcgatccggcgcgggcattggaagacgtgatcgcggccggttgccgccggctgctgtcgtccggccaggcgccggcggcgccgcagggcgcggccttgctgcgcgcgctgcgcgaacaggccggcgcgcggctggcggtgatgcccggcgccggcgtgcgggccgacaatatcgccgccttgcggcggcagaccggctgcctggagtttcacgcctcggcgcgggccgcggcggccagcggcatgcgccatcgccagccgggcttgtccatgggcgcgccgggtgccgacgagtacgcgcggcaagagacgtcggcgcagctggtgcgggaactggcgcgccaggcggcgcaggcctaggccggctgtcaggccgaggcggaatcgccgtccgggctccagctgaggtgcaaaggcagctcggcggccgacatcggccggctcaggtagaagccctgcatctccagatcgggatagtgctggcgcagataggcgaagtcctgcgggttgtctatgccttcggccaccattctcaggcccagccggcgtcccatctccacggtgctggccaggatgccctggctgcgccggtcgcggtgtatgtccagaatcaggctgcggtccagcttcagctcggtcagcggcagatcgcgcacatgctccagcgtggtgttgccggcgccgtagtcatccagcgacagctcgaagccgcgcatgcgcatccgcagcagcgaggccagggtgttgcccagattgttgaaggccagcgtttcggtgatttccagcaccacctggccaggcgctatgcgccgcagctccacttcttgctgcagccagtcgaagaactcccggtcgtgcagcaggctgcgcgacagattgatggataccctcatgccgccggtccagctgttcaggctgagcaggtccaggctggtctgcgccatgcgccgggtcagcagcatgatggtgccgtcgtgctccagccggtcgatgaaatgctgcggccccaacaggccgtgcagcggatggcgccagcgcgccagcgcctccatctggcccgcccggtggttttgctggttgaagatgggttggtagaacgcgcagaactggttgtgcgccagcccggtcatgatttcggtcagcgcaatggcgatgtcgggccgggacggagggcggcagccctgcagcaggcgatggacgcgggcgagcagccggtccgggtctatcggtttggcgcagctgtcgatctgggagaagcccagcgcctcggccgcccgggaacagccggccagcagctccggcacatcgccgctgaggaacatcagcgccggcaaatgtatccggtgcgacagcgcctgcgccagttctatgccgtccatgccgggcatgttgaggtcggtgaccaccaggtccagctgcggatgccgctgggcgatctgcatcgcccagcggccgtccgacgcctcgaacacttcggtgtccggcagcttgcggcacaactcggccagcagctggagctggcccggactgtcttcggcgatcagtatctggcggggcatcgcatactccggcgatggtggcgggcggcggcatggggatggccggccgggcggggcgtccgctatctgagttataaggcgcggcggcgtgccgccaccagatttttcgccggcttttcgtcgctgcgctcaagcgtggggctggaatcttgacgcgataaatggcataagcatgatattgcctgttcgatcccaaggagacgccatgcttgcccgttcccctgtccgctggtttcacatcgcggcgctcggcccctgcctgctgctggccgccgctccggctctcgccgcagaggccgcggtggcggcgccggacgcatacggcgcggcggtggcggcgcaaatcctcaaggacggcggcaacgcggtggatgccgcggtggcgacggccttcgcgctggcggtgacctatcccgaagccggcaatatcggcggcggcggcttcatgacgctgtaccagggcggcaagccgtatttcctcgactaccgcgaaaccgcgcccagggccgccagccgcgacatgtacttggacgacaagggccaggtgacggccaatctcagcctggtgggcgcgcgcgccgccggcgtgccgggcacggtgatgggcatgtggcaggcgcaccagcgcttcggcaagctgcaatggcggcagctgctggcgccggcgatcaactacgccgagaacggcttcaccgtcgcgccgcggcagtaccagtaccgcgacgaggcggcgcagctgttcgccggcaaaaccaatttcaaccgctatttcggcagcctgaaggccggggaaaccttccgccagcccgaattggcggccaccctcaagcgcatcgcccgttacggcgcggccgatttctaccagggcgaaaccgcccggctgctggtggcgcagatgaagcgcgacaagggcctggtcgacgccgacgacctcaacggctaccgcgcgcgctggcgcgagccgatccggatagactggcgcggcaatgtcgtctacaccgcgccgccgcccagctccggcggcatcgcgctggcgcagctattggccatcaagcaggcgcgcgccgccgatttcgccggcgtcgcgcacaactccgcccgctacatccacctgctggccgaaatcgaaaagcgggtgttcgccgaccgcgccgactacctgggcgacccagacttcagcaaggtgccgaccgcgcagctgaccgacgccgcctatctgcagcgccgcgccgccgagatcaacccgcgggcgatctcgccgacgccggacgtcaagccggggttggaatcgcgccagaccacccatttttccatcgtcgacaaatggggcaacgcggtggccaacacctacacgctgaatttcgacttcggcagcggcgtggtggtgcagggcgccggcttcctgctcaatgacgaaatggacgacttcagcgccaagcccggcgtggccaacgctttcggcgtggtgggcaaggacgccaacgccatccagccgggcaagcgcatgctgtcgtcgatggcgcccaccatcgtcacccgcgacggcaaggtgacgctggccatcggcacgcccggcggctcgcgcatcttcacctccatcttccaggtgctgaacaatctgtacgatttcgacatgccgctgaagcaggcggtggcggcgcagcgcgtccatcaccagctgctgcccaaggacaccatcttctacgacgactacgcgccgctgaccggcgcggcggccagcgagctgaaaaccatgggctacacgctgaaggaccagggctggcggatgggcgacatccaggcggtgagaatgaacggcgacgaggcggaaaccgcttccgacccgcgcggccgcggcgtgggcgtggtggtgaagtgacagccggcgccaaaggcgcgagtgcgatagattgactgggcaaacgaatggagcgggacatgcggtaccggacggttttgagcgatgtggccgacgaggcggcgcgagcggctatcgtcgcgccattgatcgcctacaatcaggcgcaggcaggggcgggcaacaacaggccgctggtgatcacggtggaggacgaggccggccaagtggcgggcgggctatggggccataccggtttcggctggctgtacgtgcaactgctggcggcgccggcggaagcgcgcggccagggcctgggccggcgtctgatggaggaggccgaagcggaagcccgcgcgcgcggctgcgtcggcgcctgggtggataccttcaccttccaggcaccggcgttctacgaaagcctgggctaccggcgcttcgccgaactggccgattatccgcccggccacagccgggtgttcttccacaagcgtttcgacgcggagccgggctgagcctctgccggccggtggcggggccggctcgcaatcagcctggataaacggcgcggccagccatgccgcgccgctttcattcggcaagagaaagtccgggtaagtaatgcttggtgattggttctagcttcaactaaaacacttaagtaaatctacattaagtggttggagcgtatcgtgactcacctgcttgcccagttcagcatccgcgccaaaatcttcggactgatcctcctcggcatcgccgcggccctcatcatcggcgtcaatggcatcacgggcgcgagcggcatgttccagctgaccatagacatgcacgacaatatgctcaaaccggtgtacttgttggggcaggccggcaagcaggcggcgtatgtcaaccgcgccgactaccgctacatcgcagaaagcgaaaaatcgcagatggaccaggtgcaggtcaaccgcgacaagttcgaggccaatatgaagggctttctcgaccaataccgcaagaccgagctgacgccgccggaagtggacgggctcaagcgctttgacgccgcctgggacgcgatgaacgcgccatgcaagaaagtgcgcgagctcagctacaccgataccggcaacggcgagaacaacaagaaggcgctgtcaatcatggccaaggagtgccgtccgctgttcaccgcggccgacgacatcctgaaggaactgtccgacatcaacatcaagctggccgacaaggcgctggacgacgcccaggcgcaataccagcgggtgcgttcgatggccatcggggtgctggtggtgggcctggtgctggtgaccgggctgggcctggcgatccagaacggcatcgtcggcagcctgaaaagcgccggcgaggcgatggtgcggataggcaatggcgacctgaacggcgaaatccgcccgcagggcaaggatgagatcgccgggatgatgcagtcgctggccgatacccagcagcggctgcgcaagaccgtcggcgacatcatgcgcgccgccaccaatgtcgcggccacgtccgagcaactggcggcgtccaccgagcaggtcagcgccagcatcggccagcaggtcaacgccacctccagcgcggcggcttccatcgaggagctgacggtcagcatagacttgtgctccagcaacgccggccaggccaacgagcaggccagccaggccggccagcaggccaaggccggcaaccgcgacgtgcaggattccaccgtgcaggtgaagaaggtcaacgagagcgtcagccgttcggccgacagcctggagtcgctgtccgatcaggcgcagcagatcggcagcatcgccaccgtgatcaaggacgtggccgaccagaccaatctgttggccttgaacgcggcgatcgaggcggcgcgcgccggcgagcagggccgcggcttcgcggtggtggccgacgaagtgcgcaagctggccgagcgcaccacgacgtcggcgcaggaaatcaccgtcatgataggcaagatccaggacggcgcgcgggtggcggtggacggcatgcgcggcagccgccagatcgtgtccgacgtggtggtggcggcggagaacgcctcggccaccatcagcacggtggagtccagcgcggcggaggtggtgggcgcgataggcgagatcgcctcggcgatgcgcgaacagcgccaggccagcaccgagctggcgagccgggtggaggccatcgcccagatgtccaaggaaaacggcatcgcggtggatgtgttctcgcaggctacccgcgagctggcgatggtggcggagcaactgcagcagaccaccatggccttcaagctggactgacggctacatgcgctggaacaggtgggcgtagctgcggctcacctccagcggctggtcgtggccgcgcagctccagcagcaggccgcgctcgtcgcggcgcacctgatcgatggcgtccacccgcaccagggtggcgcggtggatctgccagaattcctccgggtccagctgcggcagcagctccttgatcggcatgcggatcagcgcttcgcagccgacggtctgcacccgggtgtatttctcgtccgactggaaaaacagcacttcgcctatgctgatcatcctgaggctgttgccgaccgacgcgcgtatccagcgcaggtagttgggcttttccagctgccggcccagcagccgcagcgtgtcctgccattgcggcggcagcgcgatctgcctttgctgccagcgctggcgggtgcgctccagcctgtcgtcctccaccggtttgagcagatagtcgaccgcgccttcctcgaaagccttgatcgcgtactgatcgtaggcggtgacaaacaccaccgggcaggcgccgtccagctccaccgcggcggcgaggccgctttgcaccggcatggtgatgtctagaaatgccaggtcggggcggtggcggcgcgccagctccaccgcttcggcgccgtcgcgcgcctcggccaccacctgcaattccggccatacccgcgccagcgccattgtcagttgttcgcgcatcaggcgctcgtcgtcggcgatcagggcggtgacagggggcatgcggggtctccagtgtttcggggcaagggtcaggccagcacgaacggcagcgcgatggtggcgcgggtgccgccttcgggccgcacttccagcaaaagttccgcctccgcgccgtagcgcagcgccagccgctcgcggatattggccaggcccatgccttggccgggctcgtcgggaaagccgacgccgtcgtcgcacacggtcagccgcagcttgccgtccagcaccttggcccgcacttcgacgaagccgccttcggccttgggctccagcccgtgcttgatggcgttttccaccagggtttgcagcatcatcaccgggaacctggcttgcagcagcgtttcgggcacttccagccgcacctgcagccgctcttccatccgcagctgcatgatgtcgagaaaggcgcgcgacagctccagttgctggcccaggctggtttcgcccggcgattcgcgccattccggcagcgaggagcgcaggtagcggatcagcgccttttgcatcgacagcgcgcgttccggcgcggtttccatcagctggcacaccgaggacagggtgttgaacaggaagtgcggctcgatttgcgcctgcagcgcgcccatccgggtttccgccagctggcgctgcagcgcttccagctcggcttgctgttcggcccgctcgctgcgggcgatggcgcggtcggcgatctgctccgcctggcgcttgccgctggccagaatcttgaccagcaccgagaccaggaccagcgtcagggtcagcagcgggacgttcaggatgccgcccagggtctgcaccagcagcgaggcgatgaacagcctcccccaccccagacgcgccacctggtcgacgaacagccaccagtagtgttcgatgccgcgcagcgcgctgtcgccgtcggccggagcggcttgtgctcgttcattcatgatgggcctcttgtttgctttgctcattcttgccggcttgaagcttggccagcagggtggccagaatcaaaatcagcgtcagcgcgggcacccgcagcatgccgcccagaatctgcaccagcagcgccgtcagcagcaagcggccccagccggtgcgcgccgcgtagccagcgaggtgttcccagccgcagcgcagcgcggcgccggcggcgtgcagcatcggcttagccatgatgcgcctccttgtgttgcgacaggcggtgcaggcgggccagcggcttggcggcgcagtagtccagcgcctgccaggccagcacgaccggcacgatcagcgcgccgccagcgagagaggccaagagggcgaacagcgtgaagcggccccattccagctgcgacagccagtccaggccttgggtgaagtacaggggcatatgatggcagagctggatcagcgagtccaacagcgcggcgatggtttggtagttcatggtgctctcctggttggtttgtgttgtgactgtaggcgagcgggaatcggggcgatatcgacatgcgacggactgcgcggcggtggggatgaactgcgtttggcgtggatgaaatgcgcgccgcggcggggtgagccgcggcgcgcgcgggacgttcagtcggcgaacaggccgggcggagcgctgcgctccagctcgaaacgcagcagcgcggccttcagcggcagtccgccggcgtagccggtgaggctgccgtcggcgcccagcacgcggtggcagggcacgatcagcgcgatggggttggtggcgttggcgcggcccaccgcgcgcgcgccgccgggcaggtccagcagcaaggccagctcgccgtagctgacggtgcggccgtagggaatgcgccgcaaggcggcccacacctgctgctggaacggcgtgccggcgggggccagcgccagctcgaagctttggcgctcgccggcctggtattcggccagttggcgcgccacttcgcgcagcgcgccgtcgtcgcggcggcaggcgtgctcggccagttgttgcggcgtcgggttgaacagcagccgcagcagcgcgccgtcggcgttcagccaggcggccgccgggccgaagcgggtgtccagcaggccgtggcgggaggcggggaaggtggtggtcatggcgagtccggtttgtcctgtcgccattggaatccaaatccggcgaagaataaatagcggcatgcgatgcctggcgccggcgagcagcgaaatgtcatctttcccgccgcgggcggctctgattaaatggcggtgtctttcccctcgccatctctggaatgaacgataccaaaagcgccgctttggccgccgagtcgccgccggccgatgaccccagccgctcccgcgccttgctggccgcctccagcgcccatgcggcgcacgacggattgaccgacctggtgtacgtgctgctgccgctgtggcaggcgcagttcggcatcagctacgcgcaggtcggtctgctgcgcggcgcttactcggggatgatggccggctttcaattgctggccagccgggcggcggcgcgctgggggcgcaaacggctgctggcggcgggaacggcgctggccggcatcgcctacttggtcgccggccaggccggcggcctggcggtgttgctggcggccttgctgctgggcgggctgggtgccagcgtccagcatccgctggcgtcggcgatggtggcggattcccacgaggccggcggcggcgtcaagcaggcgctggcgcagtacaactttgccggcgatatcggcaaaacgctgattccggcgctggccggcctgctgctgacggtggcgagctggcgcgcggtggtcagcctggccggcctgctgggcctggccgcggccgccgcgctgtggcgcttgatcccggcgcggctggatgccgcgcgccgcgaggccaaggcggccgcgcccgcggccggccagggctcggccggtgccatgcgcgcgctgctgttcaccggcgtgctggacagcgcggcgcggatgggttttctcacctttctgcctttcctgctgaagagcaagggcgccggcagcgccggcatcggcctggcgctggcgctgttgttcgtcggcggcgcgttcggcaaactgttttgcggctatctgggcgcgcgcatcggcatggtgaggacggtgtggctgacggagacggccaccgcattgctgatcgcgctggcggtagcgctgccgctgttcggcgcgatggcgatcctgccgctgctgggcctggctttgaacggcacatcgtcggtgctgtacggcgcggtgccggagctggccggcgcggggagccggcgcgaccaggctttcgcgctgttctataccgggacgataggcggcggcgccttgtcgccggtgctgttcggccggctgggcgacgccgtcggcgtgccggtggcctcgctgtggctggcggcgctgctgttgctgaccttgccgctggcgtggcgggcgggcaagggattgcgggcttgagaggcgaaacttgacgacgatggggggcggatatggcgatggcggctgatgcggtgatcgcgctggtggcgctgctgcatgggtattttctggtactggagatgtttctgtgggacaaaccgctgggcatgaagacctttcggctgacgccggagcgggcgcgcgacaccaaggttttggccgctaaccaggggctgtacaacggctttctcgccgccggcctggcctggggactgtggctgggcgcgggcggttttcagatcaagctgtttttcctggcctgcgtgctggcggccggcgcgttcggcgccgccaccgtcaaccggcgcattttgttggtgcaggggctgccggcggcgctgggcatcgcgctgttgtggctggcttgagcggcgagcgcgtcgcggggagggcggatggttccggaaatgagcatcttggggcggttttcaggcagaaggctcaagccggcgcgcgtcgtgtttgatgagcagggcttgtccgtgctccgaggcgatgccttgcgatggcgcgtgccgctggaggagatcgcgtcggttagcctgaggcgggggcggcgtctgttcggcctgttttcgttcggccggtggctggtggcggagtctcgcggcggcaagttctatctcgaacccaccctggagtataagacggaggacctggagcgcttggtcgcgcgaatctgccagttcatcgcttgatttcgcaggatcagcttgtgtgttccagctcctgcaaaaaccgctccaacaccaaattggcgcggcgccccttgcgcaccgccagcgccagcggcgcgtcgtaatggcagatgtccggcagcagcggccgcatctgtccttgcgccacccagccggcggcgaagtgatccggcaggtagccgatgtagcggccgctgaggatcaaaaaggcgatgccttcgcggtcggacgcggtggcggcggcgcgtagccgttgttgcagcgcctgcgcttgcggcggcaagcggtagccgggcgcgacggcgttggcggcggccaggtccacctcgctcaagtcattgtcgggccggctgaacagcggatgttcgcggctgcagtacagctgcgagcgctcgtcgtacagcggcaggtagtccagcccggacaagggctggatcagcggcaccacgccggcgtgcagctggccgtccagcaggccggtttcgatgtcgctgggcgtcatcatgccgatggagatcttcacttccggaccttgctcgctcagcgctttgagcgcgccggtgacgcgcatcctgggcagcgtcaccaggttgttgacgatgccgatgttcaactcgccgcgcagttggcggtgcagcaggttcacttcgccgcggaaatcctccagcgccgccagcagcgtgtggctggcgcgcagcacttcgcggccttcgtccgtcagcgcgaaaccggctcggccgcgctggcacagccggatgcccaaccgtttttccagatcgcccatctgcaggctgatggcggagcggctgatgcccagcacgccctcggcggcggagaagccgccgcattcggccaccgcgcggaacagccgcagcaggcggatatcgaaatcgctgacttgtcccagcgcgggtttcataagttgagtttttatttatctgaacataagaaagatagcatttaactcacgcaatgtccgcggcatgctgtgtccatactcccgccacaggtgcctgacatgaacccgctcaccacccgttccgaattttcccatctcgatctgcgcgcgcactggatgccgttcagcgccaaccgcaacttccagcgcgatccgcggttgatcgtcgccggcgaaggcaattatctggtcgatgaccaaggccgccgcatcttcgacagcctgtccggcctgtggtgctgcggcgccgggcacagccgcaaggagatcgccgaggctgtgtatcgccagctgtcgacgctggattactcgcccggcttccagtttggccatccgctgtcgttccggctggccgagcgggtggcggcgatggcgccgggcgcgctgaaccacgtattcttcaccaactctggctccgagtgcgccgacaccgcggtgaagatggcgcgcgcctactggcggctgaagggccaggcgtccaaaaccaaattgatcggccgcgctcgcggctaccatggcgtcaacatcgccggcaccagcctgggcggcatgaatggcaaccgcaaattgttcggcccgctgatggacgcggaccatctgccgcacaccttgctgccggccaacgctttcagccgcggcttgccggcgcagggcgcggagctggcggacgacttgctgcggctgatcgagctgcacgacgcgtccaatatcgccgcggtgatcgtggagccgatggcgggctcggccggcgtgatcgtgccgccgcagggctatctgcaacgcctgcgcgagatctgcacgcagcacggcatcctgttgatcttcgacgaggtgatcaccggcttcggccgcaccggcaagctgttcggcgccgactatttcggcgtgacgccggacatcatgaatgtcgccaagcagctgaccaatggcgcggtgccgatgggcgcggtggtggcgaccagcgaaatctacgaggccttcatggcgcaggcgacgccggagtacgcggtggagttcgcccatggctacacctattccgcccatccggtggcttgcgcggcggcgctggcggcgctggacgtgctggagaacgaaaacctggtggccagggccgccgagctggcgccgcatttcgagcgcggcattcacggcctgaaaggcttgccgcatgtgatcgacatccgcaactgcgggctggccggcgcggtgcagatcgcgccgcgcggcggcgacgccatcgtgcggccgtacgaggcggcgatggcgttgtggcgcaagggcttctatgtccgctacggcggcgacgcgctgcagttcggcccgccgttcaccaccacgccgcaggagctggacagcctgttcgacgccgtcggcgagacgctgaccaagctggcctgaaatgattgtcaccaataaaacgagatcctgaaatgacgactttgcaacacctgatccacggcgaggcttgcgacggcggcagccgccgcgcgccgatcttcaatccatccaccggtcaagccatcgccgacgtccaactggcggacgccgccaccgtggcgcaggcggtggctgccgcccaggcggcgtttccggcctggcgcgacatgccgccggccaagcgcgcgcaagtgctgttccgcttcaagcagctgctggagcagcatgaggccgagatcgtgccgttgatcagccgcgagcacggcaagacattggaggacgccgccggcgagctgaagcgcggcatcgagaatgtggaatacgcctgcgccgcgccggcgctgctgaagggcgagtacagccgcaacgccggccccaatgtcgacgcctggagcgatttccagccgctgggcgtggtggccggcatcacgccgttcaacttcccggccatggtgccgctgtggatgtatccgctggccatcgcttgcggcaacacctttatcctgaaaccgtcggagcgcgatcccagctcgacgctgctgatcgcccgcctgctgcatgaagccggcctgccgcgtggcgtgctcaacgtggtgcacggcgacaaggaggcggtggacgcgctgctggcggcgccggaagtcaaggcagtcagctttgtcggctccacgcccatcgccgaatacatctacgccgagggcagccgccgcggcaagcgggtgcaggctttgggcggcgccaagaaccacgcggtggtgctgccggacgccgatctcgacaataccgccaacgccttgatgggcgcggcctacggctcctgcggcgagcgctgcatggccatctcggtcgccgtctgcgtcggcgatcaggcggccgacgcgctgatcgccaagctgacgccgcagatccaggctttgaaagtggggccgggcacctcgccgggcctggacatgggcccgctggtgacgcacgcgcatctggacaaggtcagcggctatatcgccgacggcgtggcggccggcgcggagctggtggtcgatggccgcggcatcgcggtgcccggccatgagggcggcttcttcctcggcggctgcctgttcgaccgagtgacgccgcagatgcgcatctaccaggaagaaatcttcggcccggtgctgtgcgtggtgcgggtgaacagcctggaagaggcgatcgcgctgatcaacgcccacgaatacggcaacggcacctgcatcttcacccgcgacggcgaggcggcgcgcctgttcgccgatacggtggaagtgggcatggtgggcatcaacgtgccgctgccggtgccggtggcctaccacagcttcggtggctggaagcggtccttgtttggcgacttgcacgcctacggcccggacggcgtgcgcttctacacccggcgcaaggcaatcacccagcgctggccgcagcgcgccagccacgaggcctcgcagttcgcctttcccagcctgtaaatcaacagtggcggatgggccgctcgcgagggcggcccgtttcgctggcataatggcaatgtcctgatcctgtctgctcgccatgaaactgtctgcttccgcaaccatcgtttcttccccttggtccatccgccgcctgagcgcggccgatatcggcgcggattggctggacgatttccagcgccggcaggaggtgacgctggtgtatcgcggcgcgcccggcgagcggcgcatcgtggccgagccgttcatcgacgactggtcggcggacgagcggcgggcgctgtgtcgcgagctggcggcgatggcggatgccgggcgggtgtggtcggcgatggaaggggaacgcctggccggcttcgccgccattgcgccggcgccgctggggccggatggcgaataccggcaattgacggaattgcaggtcgatgcccgctggcgggggcgcggcttggggcgcgaactgatggccgcctgcgtcgccggcggcagggagatgggcgcgggccggctgtacatttcctcgcactccgccattgaaacggtgtcgttctacgagcgctgcggctgcgtgccggcgcgctggctgcatgttccgcagatcgaacgggaaccgttcgattggcagttggagtacgacctggcgcgccagtgaaatgtcattgtgctatcttgcttaagccagctttcccgccgccaaggagcctgccatgcccaacaccatacgtctgcaccgcgtgctgaacgcgccgccggagcgcgtctaccgcgccttcatcgatccgctggcactggccaagtggctgccgccagacggcttcgtctgccaggtgctggagcaggacgccaccgtgggcggcggctaccggatggccttcgtcaatttctccggcggccagcagcacgagttcggcggccgctatctggagctgattcccggcgagcgggttcgctacagcgataggttcgacgatccgaatcttgccggcgagatgaccaccaccatcacgctggcgccattgtcctgcggcgccgatctcaccatcgtgcagcaaggcatcccggacgcgattccgcccgagaactgctatctgggctggcagcagtcgctgcggcagctggcggccttggtggagccggacattccgggctaggccggacgaagcgcaacaagccgggcgcatgcccggcttggttttgcggcctgcgcgccagccttgtcaatccagcggccagggaatggttttggcctgatcggcggcggcatcggatgccggcacggcaggcgcggcgacggtatccaccgcgcgccaccacggctccgtccgatcggcgtgggcgggctccagcgcctggccctggcgcggcatcagcagttggacattgctttgctcggacagggccagcagggtgtccgccggttcgtcccaggcgtgcatcgccaggttgaaggtgccccaatgcaccggcaggaaagcgccgccgcccagcagctccagggctttgagcgcgttgtccggccccaggtggatatcgccccaggcggggtggtaggcccccacttccagcatcaccaggtcgaatgcgccgatccgttcgcggatttcctcaaactggccggtgaggccggtgtcgccgctgaaaaacaccgagtgccgcggcgtgcggatggccagcgacgaccatagcgtggcgttgcggtctttcaggccgcggccggaaaagtgctgcgacggggtggcggtgacggtcaggtcggcgctggggtggcggtagctttcccaccagtccagctcggtgatgcgctgcggcgccacgccgaacgcttccagatgcgcgccgacgcccagcgaggtgacgaagggcaccggcgttttggcgagttcgcgtatcgtggggtagtccagatggtcgtagtgatcgtgggaaaccagcaccaggtccagcggcggcagctccttcagccgcactggcgccggctggaagcgtttggggccggccagccgcgtcggcgaggcgcgcggcccccataccggatcggtcagcacgcgcaggccgtctatttccagcagcaccgtcgagtgcccaagccaggtggcgcgcaggccggactccggcggcttgcgccaggcatgccgcgggtccgctacgggcagcgggccattcggcgtccgcctttcgccgccgcacagaaagtctttcagcgacggcatcttcaccgccgggtcgcgcaggccgggagcgatcggatagatgttgcggaagccgtcgtccgcccacatcggggaggcgcgcatcctttccagccgcgcgccggccgctttcttgcccagtgctttcatcgccatccttcccatgcgtgttgacgtgttgcccacactgtaaataagcgcgtccgccgcgtcgagcttggtgcgcgcgcggctcgcttgcgacggatggccggctggctagaatgaaaagctgcgggtcgcttggctgggggtgtggcgtggacgcattggatgaagtgctgctgcagttatgccggcaagaaggcctgccggatcatgccgtgctggatatgcgggtggtgcaacgccagcgctatcctcgcgccagcctgctgtattgggccgtggtggacttcagcctgccgtccacggaggccaggctgttcgttttcgatacgctggagggttcggtgcagcgttttctggtggcgcatggccggggagaagacccggccggccatgcgcattacgcccagcacttttccgatgcgcccggctccctggcttcctgcctgggcgtgtgccgggccgccgacacctgcttcggcccgcacggcctggcgttgtggctggacggcatggggccggacaatgccaatatgcgcgcgcgccggctgaccctgcatggcgcgcagtacgtggcgccggactacatccgccaacacggcgcgccgggatgctcggacggcagcctggcgatagacccgcaatacagcgtgggcctgatcaatatgctgcagggcgggtcgtacatcaattgcatccgctcgcgcatttgatcgttgctgacggcgcggcctccgcgcgcggcgttgtttttctcagtccagcgtgacgacgatcttgccgccggccgattgcgcgtccagcacgctatgggcctcctggatctgctcgaaggcgaatacccgcgccggcctggcgggaatggcgccgctttccgcccattcaatgatgttttggaacgggatgtcgcccaatggatagtcgcggctgccaaataccagggcgctggcgaagaagctgagctgccgcccgctgggcaggtgggccatgggatcgaagccggccagcggttcgtgcccgcccagaaagccggccacgcagacgcggccgtcgcgtttggccaggcgcagcgaatcgagcagggtcgaggtgccgaccagatccagcactttatccatgctgcaaccggcgatttccgccaattccgcgccaagttcggcggactccacgcgcgcgatgtccgcgcccagctggcgcgccgcttgcagccgggatgcctggctgacggtggcgatgacgcgcgcgccatgcagcttggccagcgccatcgcggcttgacccagggcggacagcgcgccgcggatcagcaaggtgtcgccgttttgtagcgccaggttgccgtgcaagcaggtccaggcggtggcgtaggattccggcagagccgcgagcgcgctccagtccagcgtggtgcgcaccggcaccacattggcggccggcacgctgacgaactccgcatagctgccattgcggctgcggcccatgccgcccattagggcgatgacggtttgcccgggcggcaaaacgccgccggggtcatgggccacctcgccggcgcactctatgccggataccgccgccacttctccccacaggccttggcggaaatactgctcggcccgattcaagccgaaggcgcggacgcgcaccagcacttcgtcggcgccggcttgcggcgcggggatgtcctggattctcagctgctccgggccgccatattgttgtctgacgattgcgcgcatgggattcgctcctgtttggtgggtgacagcggcagtttagctagcggagcatgttgaaaaaattcaaaagattaacaaaagattgtaagattaaataacaatggacttcacactgcatgagttggtctgcctggatgccgtgctgagagaaggcagcttccaggcggcggcgctgaaactgcaccgcagccatcccgccgtccacgcggcgatcaagaatctggaggcgcgtctgggcttgagcttgctggaccgcgcgtcttatcgcgtccggctgacgccgcaaggcgaggcgttccatcgccaggcccaggccttgctggcgcaggcggctagcctgggcacgatgtgcggccagctgcggagtggcgaagaaacggacttgcgcgtagtagtgggcgatctcacgcccaatgcggaggcgctggatttgctgcggcgctttttccggaactggccgcatacccggctgcacctccacttcgaggcgataagcggtccgtgggagaggctgcttgccgaggacgcggacttgatcctgcatcacgtcgataagtcggacacgcgtttcgaatggacggatgtctgccgggtggagctggtgccggtggcggcgccgggttttctggatggccccatttcccgcgatgtgagcccggagcagatggcgcgtcatgttcaggtggtgatacgggattccgcgcaggcgccggggcgcgattactttgtggtgaaggaggcgccgagttggacggtggcggatcaatacaccaagaaagacttgatcgtgcgcggcatgggctggggccatatgcccttgcatctggtggcggaggagctgcgcagcggcgcgctgctttcgctggaggggcggcatttccggcgcagcgcgctggacatcgtcgccgcgcgcttgcgcggccgtcccgccggccccgtggcgtccgcgctctggtccttcctggcggcggagggcgaagggcggccaggcggcgctcagctccgctgagcgtcatgcggcagggccgctggttttcttgagcgcggcggctaggcgcggagcgatgcgaaaacgcggcctatgccctatttgtccagcatcaatcgcagccgcagccgcagccggggttgggggctgcgcctcctggcgaacttatcggtacgccgcgccgcgcgggtcgaaccaaagctgggaatccttgagaaccttgcgcggcgtcagcgtatcgtcggatgggatttctatgatgccgcggtgcgccaggtccgcttggcgtatcgcctggccgttatagcgccagaagatttcgtcgaagctgccatcgcgcatcatcaggcgcaagccctgttccagccgctgcgccaacgcggcgttgtccttggctacgtagaaatagtaggggttggcgtaatgcagcgctaaatgcgcttccaccgccaaagacggcgtctggtcgcgatgcgctgcgtattctgcatacacttcgttgatgccgcgaggaaatagatcgatccgacgagcttctatcatgccgaacagctgtggatattcgttggtgatcacatggaatccggcccctcgcagaatatcgacatccgcccagccgcgcccctggccaaggctgaactttttcagatcggcgagcgaggctgtccggttgaactcgtcttgacggtctcgtcgaatcagcgcgatgcggtagcccagcaggcctttgcgtagcggaatgtataccggcaaagtcttttgctgcagttcgcggctgattgagccccacatcagcgtgaggccctggccttgtgtcagcgacagcaattggcggttcttgttcatcggctcgagcgatggcctggcgagcgccggaccatagcgcttatccgtatgggccagcgcgccgttcaacaattccagaatgtcggcatgtctgacatcgcgtggcgattccggcgccggatagacgatctcggtttccgccatggcccgcagtccgcagcaggcttgcagaatgagggcgaggaggcggcaggtttttgcgttcatgaacaaagaataggacagcggatggaagagaaaataggggcaggccacggttaaaagaaaaccgcggcctgttttctatttgccccttctttcccttcccggtttgccggggcgcggcatcgtgggctcagtttcccatgtcctcgctgtaattggccggaatccaggcgtaggccttggcgtcgcggcggacatggccgatgccggggaaggagatgtgcgcggcggctacccaatagccatgggccgcggcgtcggcaaaggcatggcgccgcagtttgaccgcgccggaggagtcgacatcgaagtctatattcacctgcggctgagagaactgcaccacttgggcatgcacggtatcgccccagaactgcatgcgctggccctggctctgcgcctcatagaaggtgtgccccggcgtgtgcccaggcgcggcgatggcgcgtatgccggggaacagctcggcgccggcggcgaaagccttcacgcgatgggcggcgagatagggcgccagcgaagcctgggcctgggcgaaacctttgctttgatcgaagccggatggctgcgccggcgccaccttggcgcggttggccgggttcagccagaagtcttcctccttttgattcagatagacgtcggcgttcgggaagactgccttgccggccacggtgaggccgccggagtggtccaggtgcacatgggtgagcagcacggcgtcgatgtcttccagccggtaaccggcggcgcggatattggcgggcagcttgccggcgctggggccgaacaggtcgccggcgccgctgtccaccagcagcagcttggagcccgtgttgatcaggaaggcgttgatcgaggtttccgcatggcccggcgtctggaagccgttttccaactgctgccggatctgctccggggactcgccatgcaacagcttgtccagcggcactttgacggtgccgtcggacagcgcggtgatttcgaaccggcctagcatcatccggtaatagcccggcgcctgggcatggatttgcggcgcggcggccaggctggaggttgcggagagcagggttgccgcgctgatggcgacggcggcggcgatggctttcaattggcggagctgaggcatgttggttccttatcaggcggtagcgcaagcggtttgctcgcgtggcctgatcatgttccaatacgcagtcatatcattcaaatcgattgaaaagatgatgactatcagcgaaagagattttcgcgcggttgatctcaacctgctggtgactttcctggtgttgatgcgcgaacgcagcgtatcgcgcgcggccgagcggttgttcatcggccagcctgcggtgagcggcgcgctggcgcggctgcgcagcctgttcgacgacgagctgctggtgcgcggcgccggcggcatggagccgactgcgcgcgccttgcggctggaggccgagctgttgccggcattgcaggatgtgcaggcggccttgtttcattccgagcgtttcgatccggccggcgccgaacgagctttcacgctggcgatgccggactgggtggaggtttggctgatgccgcgggttttcgccgaactgcgccgccaggcgccgcgcgtccgcgtcgccgtcaaggccaccgaccccttccagggcgcggccatgctggagaggcatgaaatggagctgggcgtggcgacgctgccggacaagccggcttggctgcgcagcgttccgctggccaggatggggttcagctgcgttcatcacggaaagcggctgccgctggccggcccgctcaccctgcgggattatgtggcccatccccatgtgctggtcacttatcgcggcgcgttccgcagcggcatagaccaattgctggaagcgcgcggcctgcggcggcaggtgcaatacaccacccagcagttcagcaccctgcccagcctgctgcgcgaagtggcggcgctgtccagcgtgccggcggcgctagccgatcattgggcgtattgccaggatctgcatgcgcatcccttgccgctgccgtcgccggaaatcgagttgtcgatgttctggcatgcggccaaggacaaggacccagcattggaatggctgcgcggcgtggtggcggaggcggcgcggacgccgctggtttgacgggggcggagttctggcgcgccgaggtctggctcagggttccatggcgcgccacagcttggtctggcactgcgcgcattggtagatgcggcggtattccaccggccgcaatagtccgacggagagaatgtcgctgccgccgcaaacgtggcaatgcgggacgccatggctatggctggctggatggtcttgccggtatttctccagcgtggggaatcgcagccagtacttctgcgcggccggctggtaggccagaaaatagaatgacgcggcgccgatcggcaaaaccgcgatgaccatccaggcgttcattttttctccggtgtggttttgcgtgttgcggacattcttccaccgaaagcgagaggccgtctaataaaaccatgtttattttaaaagccgggcggttggattacgtcaaatcaggttttaagtaaaaacgaggccatttcgccattaagcggccaacacgctagcggatggcgcgttggcgctggttggcagagggcgatgtggatcaagtgccgcggagcacggaatccattggagcggccccgcgtggatgggatggccgggatcgtggcgggggccgtggttgttttcccgcgcggcgacgaaaaagccccgcggcttgaggccgcggggcggaggaaaaaactgcgcagcatcgcgcttgactcagccgcatgcccccacatggccgcaggcggtgcagaactcgcagccgtctttttttatcagcgcgtggttgccgcattccgggcaggccttgccggccagcggcttgagctgggccggcgcttctagcgcgaacaggtcgctctgctccggcgccatcacgcccatttcctccagcggcacgccttcctcggtcagcacgcccagcatcgcgtagcggtggatgatcagccgcgccagatacgcgacggtggatggccagctttgcgatttttccagtccgggaatgcgggcgaagaagtcgccctgcggctcggcgtagttgagcagcttgcgcagcttcaggcctatccaggccgggtctatcacccgcatgtcgagggagagcatcttgcacaggccgtccagttcgcgcgggtaggcgccggccagccataccgagtacggccggcgcttgccgttgggcaggatcagctctttgatgaacagcacgaagtcatcgccggtttgcggattcaccacgtccaccgaccagctcatggtgccgtcgctgccggatttcggctccttgcgggcgaacagcgcgtccatcaccggcgtggcttcgccggcgtccagccgcagcgcgcccagttgctcgacgcggtggcgcaccacctggcccagcgcggcggcggccgaggtggcgtggatggccttgtcgcccagcgtgaactggtagcgcttgtcgccgttggttcgcgacagcgcgtccagcttggcggccagccaggcgcggtcgcggcagcgcatgtccatcgacagcgttttggcgatggcggacaggccgcgctgcacttcggtggcgttgacccagcattcaaacggctggacgcggccgttttccatgtggccgaccaccacggcgaaatcgccggcgtcgccttccaccatgaaggtccacgacgggttgccttccttcagtttggggcggttcggccatttcaagctggatagcgccggggtgggcgcggtgttgagcactacgcggcggtccgggtcgttggcggcgccggacaggtcttccggcgcggcggcggcggcttgcgccggctccagcgacaacaccgaacccagcacattgttggggcggtaggtggtgatgcctttcagcccgttgcgccaggcttccaggtacaggctttcgaagtcggcgaacgggtagtcggccggcacgttgacggtcttggagatggcggtgtcgacgaagggcgcgacggcggccaccatccgcatgtggtccagcgcgctcatttccagcgcggagacgaagtagtcgggcaggcgcgcggtgtcgccgccctgcatccgccacacgcggtaggcgtggtcttccaccaggtattcctgctgcgtgtcgtcggccatccgctttttgcgggtgtagaaccaggagaacggcggctcgatgccgttggaggcgttgtcggcgaaggccagcgagatggtgccggtgggggcgatcgacagcaggtgcgaattgcggatgccgtgcttgcggatgcgcgcctggatcttgtccggcagccggctggcgcagtgcggcgcggccaggtaggcgtcggcgtcgaacagcgggaaggcgcctttttcgatggcgagatccaccgaggcgtcgtaggcggcgtcgcgcatgctctgggcgatgcgggcggcgaagcggcggccttcctcgctgtcgtagcgtatcttcagcatgatcagcgcgtcgcccaggccggtgaatcccaggccgacgcggcgcttgttctgcgcctcgcgctcctgttccggcagcggccacacggtcaggtccagcacattgtccagcatgcggatggacatccgcaccaccttctcgaacgacttgaagtcgaagtgggccttgtcgccgaacggcgcgcgcacgtggcgggtcaggttgaccgatccgaggtcgcagcagccgtagtcgggcaacggctgctcgccgcagggattggtggattcgatcacctcgcagtaggacaggttgttgtcctggttgatgcgggtcatgaacagcacgccgggctcggcgtggtcgtaggtggattccatgatctgccgccacagcgcgcgggcgcgcacggtgcggtacacccacaggccgtcttcgcggcggaagctgtcggggaaggcgtcggacgccggctccaccgcgtgggtcagctgccagtcggcgtcggcttccaccgcctgcatgaaggcgtcggagacgccgaccgagatattgaagttgcgcagatcgccctgatccttggcgtggatgaaggcttccacgtccggatggctgacgtccagcacgcccatttgcgcgccgcgccgcgcgccggccgattccaccgtctcgcagctgcggtcgaacacgcgcatataggacaccgggccggaagcgcggctgttggtgcctttcacatgcgcgcccctggggcggatgcggctgaagttgtagccgacgccgccgccgcggcgcatggtttccgccgcctgcagcagcgcctggtagatgccggccttgccgtgttcggtttctgacaccgaatcgccgaccggctgcacgaagcagttgatcagcgtggcggacagctcggtgccggcggcggaattgatgcggccgccggggatgaagccgtggtccagcgcctcgaaaaacagcggctcgaaacgggccgggtcatgttccagtccggccagcgcgcgcgcgacgcggcggcgcacttcgctgacgctttgttcgccattcttggcgtacttttccagcaacacctcgcgcgagatgtcctgttccgccatggcggcgatgttttcctgctgcatggagcgctcatccttctgaaacggtgttcaacgacgatggcatggccggctgcgcatgaaaaacggcgtagcacactatatgttgttacgccgtgatggggtgaaacgcaagttgttgtgttccggcgccgtttgggattgtactccggatgcggcgccgggggctatttcgcggtgattttcaccgccagctccacgccgtcgcggttggccgaggttttttgcggcgcgtccagcgtcacgcgttcggcgaggtcgggcgcatggcgcagcatcaccttgcgggcgttggcgccacgcagttccgccagcttgacgagatcggcctggctgactttttccgccgccagcatctcgtcgcgcagcagtttggccagttcggcgccggacgggccgccgggcttcagcgtgtggcccagcagcttcagccggccgatgcgctggccgtagacggttttgatcgccgactggatctgcgcgtctttcaggtccagcgaagccagcggctcgtcatccatcggcgcgtggccggcggcggccagcaccgcggcgtcgacgcgcgcgcgcgccagctgcttgctgtcctcgtccggcgcgtagccgccggaaatggccagctgcatcttcggccgcttggccatcagcgccgccaccttgtccagcttttcgcgctccggcgggctgacgtgggcttcgccggcgacgaagcggatgtcgtcgaagccatcgccgcccagcagcgcccccaacgcgcggaacggcgcggtgaccacct

(The sequence listing continues in the following parts.)

What is claimed is:

1. A cell comprising:

a recombinant vector having a heterologous promoter operably linked to a nucleic acid encoding a polypeptide with 100% identity to SEQ ID NO: 8924.

2. A plant, a plant part, or a seed comprising:

one or more cells comprising a recombinant vector comprising a heterologous promoter operably linked to a nucleic acid encoding a polypeptide with 100% identity to SEQ ID NO:8924.

3. The plant part of claim 2, wherein said plant part is selected from the group consisting of pollen, ovule, flower, shoot, root, stalk, silk, tassel, ear, and leaf tissue.

4. The cell of claim 1, wherein said cell is a bacterial, mammalian, or fungal cell.

5. A method of producing an insect resistant plant cell, said method comprising the step of:

transforming a recombinant vector comprising a heterologous promoter operably linked to a nucleic acid encoding a polypeptide with 100% identity to SEQ ID NO:8924 into a plant cell.

6. An anti-counterfeit milled seed comprising:

a plant cell comprising a recombinant vector having a heterologous promoter operably linked to a nucleic acid encoding a polypeptide with 100% identity to SEQ ID NO: 8924wherein the polypeptide provides an indication of plant cell origin.

7. A pesticidal composition comprising:

an isolated and purified polypeptide having the sequence as set forth in SEQ ID NO:8924 and one or more artificial pesticides disposed in a carrier.

8. The pesticidal composition of claim 7, wherein at least one of the one or more artificial pesticides composition is an insecticide.

9. A method for modulating a pest infestation in a plant, said method comprising the step of:

contacting a plant or a plant part with an amount of a pesticidal composition comprising (a) a polypeptide having the sequence as set forth in SEQ ID NO: 8924 and (b) one or more artificial pesticides dispose in a carrier, said amount effective to modulate said pest infestation.

10. The method of claim 9, wherein the pest is selected from the group consisting of insects, fungi, nematodes, bacteria and mites.

11. The method of claim 10, wherein the insects comprise cabbage loopers, lygus, beet armyworms, corn rootworm, or diamondback moth.

12. A seed or seed coating composition comprising a polypeptide with 100% identity to SEQ ID NO: 8924, and one or more artificial pesticides disposed in a carrier.

* * * * *